United States Patent 12,642,819 (COMPOSITIONS AND METHODS FOR TREATING INFLAMMATORY BOWEL DISEASE) - sequence listing, part 45

SEQ ID NO: 15 - DNA, 5204063 bp, Bacteroides vulgatus (residues 3,469,377-5,204,063 of 5,204,063)
  modified_base (1563758)..(1563854): a, c, t, g, unknown or other
  modified_base (1945760)..(1945856): a, c, t, g, unknown or other
  modified_base (1973539)..(1973638): a, c, t, g, unknown or other
  modified_base (1977547)..(1977645): a, c, t, g, unknown or other
  modified_base (2249839)..(2249854): a, c, t, g, unknown or other
  modified_base (3445641)..(3445738): a, c, t, g, unknown or other
  modified_base (3811886)..(3811984): a, c, t, g, unknown or other
  modified_base (4302933)..(4303032): a, c, t, g, unknown or other
  modified_base (5118731)..(5119653): a, c, t, g, unknown or other
  modified_base (5121090)..(5121232): a, c, t, g, unknown or other
aataacgatgaagaagtgtcttcccgacattttccataagtgaaacttggcttattgcttgcaatccagaccttgatatgccgaaaaaaggctcagaactcagatggggaatgacatcaaaaaaaaggtcggctgaccaaagaccttcccgatacaaaaaatgaaaaggtcttgaatctagctgaagaataaatcagatgttcaacttaaataatgctaatatggaaaatttgattacacaaatcaacaaagagagattggttaatagcgacacagctcttatgatgaaggaattatactattacgtgccttgtgagtattggtatgacaaacaggataggctacgcaccgatattgagggaaggaataccccgatgtatatgtgcgagtgcccgacactggcagcatgtatccaatggatgatacagactcgtgaatatacgtttcaaacagaacaaaacgtggcggtctggcatgtggttgtgagggctggagattatgtgttgtatgactccgaaagtaatgcggacgctttttgttgtttggaagaagcattggaaaaagcggtacaggagtgcatggagttattgtattaaaattaaaaaaaatcagtccccgtgaaggggactttcctataatcttgctgagaggtggaattgcagacgatctttgagaatcatctttgaaggatgggcagaggtttattcgttatttgttatttttgttctcggatttcagcgcaattccattccttcttaataggcgatatactgttccgctactgcctatgtttaatattttctgtatctcccttaccggcgttccggattcatagagttggatgcagcttttctgcttggcgatgttgtttttgttgataagtgtctttctgccgaatttgacacctttttccttggcgattcttctgccttcttgggttctctcatagataaggtctctttcaaactgagcgaaagcaccgagaatgttgttcatcagttggccgattgcgccttccgtactgatgttgtcttgcagtgaggtgaattggatgcccctattcttgaaatcttccaatagcgtaaggatattcttcagcgaacggccaagccggtccagcttatatacgacaagtgtgtcgccttcccggagaaagctcaggcaggcatccagttccgggcggttttgttgacgtccggtcattttctcagagaagattttctcgcatccggcagccttcaacgcttccagttgcatatccagatgttgttccttggtggaaacacgggcatatcctattttcatcctgttttcgtatttaaatgtgtaatgaaggttttaattcttcactttttcaaatatgaagacattaattcttcatattcctcacggctgtattggttgaaccccttttgcttcattgccaaaagaagcctttccagttctccgatagtcactacctgtttgccgataacggtaaattgttcccattctcccttttcgttgagcaggtattcccggtgtgcaaaacagtaaagagaaccatcgatgtcattccgtttctgccattgacgcaggtgcttcaaactggtgaaatcacgggtgacagtacgtggaatgggaaccaatacgtcaatttccatcttgaattttatattctcttccgcttctcgcatgggtgattagcttatttcataatacatcaattatcgtatgggcaggaagttccagtttggagaaagcaaacattttcttgcccaaatcctttagcgatgccccaatatgatatacttccgtattatcaatgattaagaagcggtcatgactacttttgtaggttctagcttcaatgggaggatattggtcattgtgtttgtttaaatcaagttggagctgtgcgtttattttgtgtataaatagtagctgatactccactgtttcgtttgctcaacatgagtaacacggattcatctacatagttgtcgataagcacaagtgagcatttggcagactttattaaatctgtagcaaacttatacgcatcgaatatctgaccgtcaaagaatataccttccaccggaggcaatgaggtgcgtacaaagaagtctatctttgcatcatgttcagcaatggttttctctatttggaagaatctattgttcattctatattccatgtcattgagccgttggtttatagaataacctttcaataaatattcttttaaaattttatttgcccattgcctgaattgcgtacctcttacgcttttaactctgtatccaactgaaattattacgtctagactaaagaacttgacaggcttatcggaattagcaatgtgcaaaaaatgcacattgcttttctcttccaattccttttccttaaaaacattatttatatgtttggtaataacggttctgtcacgttgaaaaagttctgctatctgcgcttgtgtgagccaaacggtttcatcttctaaacgtacttccaaccttacagcttcatccggttggtatagtatgatttctccttgcttctccattatatgtttcgcttttattatattgttgcaaatgtacgaaaaagaaacgttataaagtctgttttttccgtaagtattaccttaaaaatttgttccctttttattttaataaaacagaaacattctgctgttttaaaaatcagttatctgtttgctattcatagttagggtatcaaataactaaaattcaaatggaaacgcaaatctatattttatgcagatttgtttgttagaagcggagaaaaggacacaagacatgataagaatcataggtcggggagcgccgcacggcaaggggggcactagcctcccgacgagtgcagccgttggccgggttatcggtgaaaatggaaaaaagttggcttttcttttggtattgttataactttgtctatatttgtgttgtgataatcaattttaaagttataacattatggtaacaaacattattcagattggaaacagcaaggggataatacttccttccgagatattgaaacagttgcgtttgtccttgaaatcggctgtgagcatttctttggacgggaacaatattgtgataaaggcacaaccacggcagggatgggcggaagctgccaaacgtgcccatgagaatggggatgatgagttgcttatccctgatgtgtttgaggatgaaaagtttgaggattggacatggtagaacagtatggagtgtattgggtagagttagaccctacccgtgggggtgaaatggcaaagacacggccatgtgttgttgtaactccttcagatttgaatatgtaccttacaatagtagtcattgctccgataacctccaccataaggaactatccttaccgggttctgtgttctgtagccgggcgtgatggggagatagccacggatcagattcgcacggtggacaaaagccggctgaaaagaaagattggagatttgaatttcagtgagataaaaagactgaaggaagtgtttcatcaaatgttctgtgaataatggaaagtgtgcaaataacaggttatgtagcgtattcaaaaaagatattatgaagccaactacttatattaattgggacggtctgaaagacattccattcttctactgcgatacaaaggaagatgaagaaaacaaggatttcgacatctattaccagggcaagctggtgttgcatgactacaaccattgcggacactacctttacactgctgcgctgctgttcagtaaaatcagaaacattacagccgactgggtgaacctgcataacctttggattctgcgtgattgcgtgcgcgagaattacaatcacggcataggagtggacgaccttattttcggagagaatttcgatggcaagaacctcgatacactcacaccgcttaccaagaaacgctttgattatttgtgtaagcggattaaggaacttgacccatacgcaacaatttaacacttcattgggcgaaggcagggcttgctgcggatgccagactttaaataatccattggattaattatctttgcacgctaattttcaaattataaagaaatgactaaatcggaaatcgtaaaggaaatatctgccagaaccggcatcgacggcaaagcggtgcttgctgttttggaaggattcatgaacgaggtaaagacttcgttgggtaaggaggaaaatgtctatcttcgtggattcggtagtttcatagtgaagaagagagcgcaaaagacagctcggaatatctctaagaatactactatgattattccggctcataacataccggcatttaaaccgtctgacgaatttttgaaaatggtaaaacaacagaacgcataataggtaaacacaatgaaagatcagttacgattattgagagactgtatcaataatgatcgtccggcagttgtctttcagggagacgatttttgcgctcctgagattttggaagcagcaaaagaaatttatcgtaaacatggttgttccgaagaatttctttttgactggcagctgcttatcaatgaggtgaaggcttaccagttagaaagtccggcaactgtcaaattgccgaaactctccccgacagaaacggaactggtgcgggaagagatgactaaacgctaaaaaatattctcgtttaatacgcaccttttattcttcaggcagcgtattgaacgggatgggattaaaatgttggcgaacctgcttttttcgaaagttcctgccaatagttgaagtcactcggtgaaagatgctcttgcatccagtcacgcataccaatatcgtttctttcgttcacatatctcgtaaacggaatcattgtcttacatgcttcaaatccaagcattctcatatggcgtgaaatgttgggaggaagaccttccaaccactctttataatacattatcaatctgttttcttggattggaaccgcttgttggtggtaaatatagctggcgtttccgattctaatatctctggccttattttcccgttcttcttcaggtagccgacttaaatattcagcttgtgctattctgcatttggagtttggatgttccatggtattttatataattaagactcttcaatgatacggttcatcaaatcacatattttttggcagctatgacggtctgcgcaagcaggataggggcatttctcaaaggatgcctgattatccgtaactatgaaacctccggaacgacgtacataacttaccggatgaaaataaatatcttcctttttcggcctataagtacatagtcttataaggctgttcagctctttgcaaatttgctcacatttttctttgggataatgtggcaaatcactgaatgcttcgtaggggacaaaggcaaatgctttgtcatcccacatgacaggtgtgtaattctgtaccatttgttatttggaataaggatggctggcagattccgtatttctgtatcagttaggtaatccgtcactatttaagtgcgcctgggcaaactcccggaggttcgtttcggcaatgcacttttcataaatctcatccaatacttcttgcatattttctactttattgaattttaaggggctgccgtttgttgcggcttgcctttccagttgttcgatgatactgggaaatatcccacgcaataaaccgacggtagctacggctgtagctggttctacctctattgtaatctttttcttttccatatcgttgtattatgttatcaaaagtaataattattaggatattggtaagcatttcttctgaaaaactttttaaagatattgttttaagatgacatactgtgtttttgcgttcacgcagtattctttcccaccctccccttcatcggaatgactgttctcatttccggtttacccgtagtcatccgctatgcggctgattatgggcaaaccagaaaagagaagttccacaaaggtaggaaggaaaagaggggaaaaaaacacgcacgaggccgaatgcttacgtatcacccatgtgatgaaaattgatcaccttagtgataaaacttcatcactaaggtgaaacgataaacaggaaagggcagcgcaacgatttctatcggacgaaaaactgtgtgtatccttggcttgactatataagatagcgcgtggcaagattgccattcaagagaacaaggtctcgcctcggaaatagaagaccgggcggggggggagtctgggacaaacttacagagatgaagaatttatgaaggattgaaaaaaatccttcataataagtggcagtaaatcaacttgctaagccataatgaaggatttgaaggaaaaaaacggttaaaaacttatttccttccctaattccttccagtccaggatacccttatccagattatacaccttgaatcctttttttaccagaatgttggcggcattgcggctgcgtcttccacttttgcagtaaacggctacagggcggtctttttgaagaagctcctcgatgtttgtgccaaactcattgtccaatacattgatattgatgctgcccggtatatggccttcggaatattcggctaccgtgcgtacatcaaccagttggatggtcttgtcctgtatcatttcctcaaactggtcggaggaaagattcttgaatttgtcactgtctttgccagtacatgcccataatcctagtgagaatgcgcagatgaagaatacaaaatagatggtctttatcataaaatggaatgttttgatgtttttgtttgctaaaaataaaagatacgactagtcataccttctttgtaagtacggatgttgaatacaatcttatcgcctttatgcagtttgccggcgtatgcccacaagggaacagacagatagactttacggttgaaaccttcgatgtcattattcctgtcatgatagagtgtcaagtataatgtttgttctccgtctttgttctccagtttgttctcaataaagtgataaccgtgtttctggtctttgactttgacttgtaaaatcaggttcaggtaattcccaccccgccaaatgctttgaatggctaccgggtcggtctttatctccttgaatttagattcggacaaaggaacaggagaaataaccagttgggtattgtaaagcatggcttctttttctgcttcttccgagtctgtcaatggagcgtacatggtaaccgtgcggtacgtggtgtctggtgccagtccgtcaagaccggtacgtgactggatgcgccactctgtcccttcatccgttatcagataccgtccggttcctgtatggtcggttttcaagtcgatcatatctgtcagaacattaggatatacatagtcgtcttcaccgcacgcgccgagaagcaaagaggttagaaaagataaaataacgactttcctcatgtttattattttctttttcagggtggactgtaacatccaccctttacggtaaacgttcttatccttttgccgctttcaggtaattgatgagcggattggcatacatagtcagcaaagcatgacgcaggaaggcggtgtctttgttgggaagatcgactttggcaatctgctgttccagatatttttcaaagtgctctttttcttcttctgtgtactcggccgtgaaacggttgtctcccatcaagaggtcacacgccacataattacctgcaaacaggcggtaactgctgtggatatgccggtctatggtttccgatatggcggtaaacaaatcacatttcggcaaattgagttctttcagttcgtccagttcatgattcagacaggcggaggtctggaaatggatgcgtcccttgtatccgtaaaggccggtctgcatattgatcaggtcgtcttcggggcttttctggaaatgttcgtcatcgcgtttttgctgcaactcttttgctttcaggaagtcacacgggtcgtattcgtaagaaatggctagcggaacgatgttcagttctttcagtctttcggtaacatcgccttcacctgccatggccatcattttcaatacactgtcctgggtacggtcattggaatctttggcacgtccctgacgttgcgctatccataaattctcatgtttttccttcatggcgaaatgcatgtagcgcgacatcaaggcagatgcttccagtttctgccgcatgttgaggccgcgtttcacgatgaatgatttattgacacgtaccagcttatgaatccatgggtagatgagcaggttgtcgccgatggcgatctctacggttgtcattccgttgtctatcagtaggatagatagaaaagccgagtccagaataatatcacgatgattggagatgaaagtgtagttccgggttaagtcggacaaggcggaacagtcgaatgtcagtccgttggctgtttttttcactaaatcccataatagtccgtaaaagaacgctttttggaattccaggtttgttttgcattgacgcatcttcatggcaagaccttcgaaaggtacgcccggcataacagactctaccactgtccggaaagcgggatcagcgattaattcttcatagatttgcggcaactcttcgggagtgtacggacgaatctcgttaaattcagctggtatgttcataatttataaaggttagtcagtgatatcactaaaatttattttctataatgtcagtcatcacatcttttatatccaatcctgctgcacgcacctgttggggaatgaagctggtagctgtcatgcccggagtggtattgatttcgagcaagtttactttttcgccttcggtaatgatatagtcaatgcggataaggccggagcatcccagaatgtcataaatggccgaggtgagcagacgtacacgctcggctgtatcttcgggcaggcgggcaggtgtgatttcctgtgactcgccgttgtatttggctccatagtcaaagaattcgttggcacttaccacctcggtgatggggaacaccacttccttgtccgaggtcttgtaacagccgcaggtgatttccgttcccttcataaaggcttcaatcattacttcgtcactttcctcgaaagctttttcgatggcgggttgtatatcttccttagtctttactttggtgacaccgaagctggaaccgccggcgttgggcttgatgaaacaaggcagaccgattttgttgattacttcttcgtctgtaatttcaaatcctttacgcaggatcagtgattcggctacgcggataccgaagcctttcaggtattggttgcaggtgaatttattgaaagtcatggccgataccagtacgttacaactggagtaggggattcctaacaggtcgaagtaaccttgcaggataccgttttcccccggagttccgtggatggtgatgtaggcgaagtcgaattgtttcttttcgccgttctccatgaaactgaagtcattacggtctatcggggttttggagccgtccggaaggactacttcccaccgatgcccttccatctctactatatataggttataacgctctttgtcaatgaaagagtaaagtccctgtgcactgcgcaaggaaacgacaagttcgctggaatctcctccggctactatggcaatagtacgtttcatagttcttctctgttactgatatagtttctccacttgtctatcaggtttgtcatatcctcgggcagcggagaggtgaagaacatctcttcgcctgtacggggatggacaaagcccagcgtcatggcgtgtaatgcctggcgggggcaggtctcgaaacagttgtttacgaattgtttgtatttactaaaatgagttccttttaaaatttcgtttccgccataacgctcatcgttgaacagcgtgtgtccgatgtgcttcatgtggacacgtatctggtgggtgcgtcccgtttcaagtacacactctaccagcgtgacatagcccagacgttccagtacccgatagtgggtgacggcgtgttttccttgggcggggtcactcagtacggccatttgcatgcggtctttggggtttcgtcctatattcccttctatggttccttcgttattttctacgacaccccataccagagcattgtatttacgtttggtggtcttgttgtagaactgaagtcccaaatgagtcttggcatcgggggtcttggctaccacgagcaggcctgaggtatctttgtctatacggtggactaatcccacttgcggatcgttagggtcgtatttgggattgtctttcagatgccatgctatggcgttgaccagcgtgccgtggtagtttccgcatcccggatgcactaccagtccggccggtttgttgactaccatcaaatcgttgtcctcatagactatatccaatggaatatcttcgggaatgatatcattatcataacgtggacggtccatcatcaccgtcagcacgtcgcaaggctttactttataactgcttttcaccggtttgccgttcgccatgataagaccggcgtcggcagccttctgaatacggttgcgcgaagagttgacaagccgttcgaacaaatatttgtccacgcgcacctgtgactgtcctttgtctactactacacggaaatgttcatacagttcggcagggttgtccactaccggttccacatcatccagtgtatcgtccagttcatccacatattcttctttcatcatcactgtgtgttaagtttaaaaccaggattcgtctaccaccggtttgtcatcgttcgcagttccggattcatttaccaatgcagaatcttcgggcatggtttcattgccgttgcctaccgtgagtgtcagtacggcttcgtgaggaaccttttctccggctttcaagtcgcgtcctcggtattttatgctgtatacccagtctttttcgccgctgatatattcgggttcggttattttaaaacctaatgcacgtaatttagcttcggcctggcggagagaactattatccatgacatcgggaatggctaccttgggggcgctgtctgcattgacggtcagatagacggttctgcccgacttcaccttggagccaccggcgggattctgttccagaatagcaccgggggctattccttttacatagctggagtctatgacgattgattttagtgactgcttgtcgagttcattttctgcgatccgcagattcattccttttacatcgggcactaccactgcttcgccgtggcgtgtatagctgtccagccattgaagggttccccaggctgctgccacaatgaccactaccatcgctatcagattgagccagaagaagcggttattcttgaatgaaaagaattctttgaatgttaccatatctaacttaattatttcgggtcaaagatacgacaatttcatttctgttcctacatttagttatgaatatcatatactttttgtacctttgcaccccgaaaaaacaacctgtttcctgtcagagtaaacaaaattgaggtaaaaagaagatgaacgagacaacaaatgaacaagaggtgctgctattgcgccgtaaactagaccttttattacgtaccggcaagctgctgatggagagtgcggcagacactaaccggattgaaagaaacatgaagcgcgtggccgcttatctgggcattccggaagagaaactgcatattgatatccggtggacgatgctgatggtcaatgtgagtgacgagaagcactctttttccaagtttcagaaatgcgagaaacatggcatcaatatggaagccatttcaaaaatcagtaaactttcgtggcgtgccattgagcaggattattcattggataaatacgaggaagaactggagaagattgctcgtcaggagcgtaattataccccctatgtcgtggcaatctgtaccgggtttgcctgtggagggttctgcaagctgtttggtggtgactggattgcttttctgattacggctatttgtacttttgtggggttccgtacccgtgcccgttgcattgagttcggtatcaatgtatatatgagtattgcgatctctgcatttttatgtacttgtctggcttatgcgttttctttttcaggtttatcttccactccgtatcatccgttgctggcctgtaccttatatatagtccccggtgtgccgctgataaattttgtggacgatatgattgacaatcacttgttggtaggtattacgcgtgcagccaacacggtaatgatggtaggaggcatggcgtttggtatcgcttttgccttgaggctgctggtgatgagtgatgtgactatcgaccagaagttcagtgaactgagcatggtgccgcacgatgcttattgggtatatgctgttgcggctgctattgcggctatgggattcgccactatatttaatgtgcagagacgtttgttgtgggtggtggctgtaggtggaataattgcagtatgtacccgtaactttgtaaactttgaattaggatatggtccggtgatcggttcgtttatgggaagctttgtcgtgagtttgatagctgtcaaagccgttcattggtttcatgttcctaatcatgtgctgactattccttctgtcattccgatggttcccggtgtcttgatgtatcgttcgttgctggcgcttatcaatatgcgtggagtggtaggagaagtgacacttgctttttccaatggtattaactcggcgcttatcattttctgtatagccttgggggtagctgttcctaatatttttgcccggcgttacatagccaaggaccgccagcgttttcttacacagatgttggcggaacgcagagctcgtggtaaatttatagagtggtagctggtgtatgtaagcagtattcattaaaacttgatagacaaagaaaaaggattttccatgcaggaaaatcctttttctttgtctatcaagtttactctattaatttctgggtaaggcttcttttactaccattggacgaccggcatattctacgccgttcaactgtttgatagcgtttgaagcttctgaagtttccggcatttcgacaaaggcgaaaccttttgatcttcttgtatcacggtcaatgattaacttgactgagcctactgttccatactcttccataacttctctcaaatctacttccttaacgttgtagctaaggtttccaacatacatattcataactgtcaatataaaaaattaataatctaacaacgaaatttcaagaagctctaaatcaggaatgaatatactcaatgtggataactgagaagatacatgatgagaataaaactagaataaatctctaattgtttgttggacaaagtaaactctttcatttggataatgcactatatctctgcttttattccatgttatatatcatttattattataaatggtcggaaattaacataacatggaatgaaaacagggttttatagggttattgagtgttgacaggcggtttctctctgtattgggtaggggaacaacctgtatgctgtttgaatacagtgctgaaatatctggcggtcgagaatcctgtcttatctgctatgtcattgacactgagttctgtatggagaataagccagatagctctctccatacgtattttggttatatagtcgttggctcccatatctgtcaatgctttcagcttattgtataaagaagctctgctgattcctattttgttgcaaatgaatggaatacccaactgttcgttatccagatgttctgtgattatctgattcaggcgatttaaaaattcttcatcggccgaactgaaggttccttcttcgggtggcggcagaggaccgatgtctgtatagcgggtacgcatccgttcccggttatgcagttggctacagacaattgcatacagcatacttacttcaaaaggttttgtgatgtaggcgtctgctccgtttttataaccatatagttggctttcttcgtcattacgtgcagtgagcaggataaccgggatatggcttatttccaaatcttcttttatttgtttacatagctcatagccgttcatatggggcatttggatatcgcttacaactatatgaggacgtttttcccggcaaagacgcaatgcttcctctccatcggcggctacccatattgtcttaaaccggtctttcagggctgttgccagataatcggtcaggtctttgttgtcatctactattaataaggtatggcttggggctgttttattttcttcctgttgttcgggaatgctttctgtttcttgcgtgggtgccaaaagtgtattcagatattcttgtgggtgcagcgtgatatttcccggttcggtatttaatggaagttcgaaccagaaagtggctcccggacttccgaaattcttgttgtcgtaggctccaatgttgcctccgtgttgttcgaccagtattttagaataggacaatccgattcctgtgccgggacgactgttgttgccttggtaaaagcggacaaagagattgttggtatccacatctttcagtcccggaccttggtcggaaatggatatgcgtactcttgtcctgtcttccgacaaacgggttgaaatgctgattgtactctcatcgggagtatatttcaatgcgttaattaataggttggtcaggatagtggtacatttttctttgtcgaagcacaaggtttgaatctccggctcaggttgatagacgagtgtgatgcctctgacggaggcttccggtttaaaatcggaaatcagttgctccgcccattcatccaattgtatgctctggatatggagtgtgctttgtcctacttccattttgcgaacattcagaacagtattcagaatgttcttcatccgttcagattgtttacagatgctttggatcaacggataattttcgttgtcggcggtaagtttgtccattagttgtttcaagggtgcatgtatcaaggtcagtggagtccgaagctcatggctgatgttgatgagaaagcgtactttttcttcgtatacctgctgttcatgttctttcattgcccactttagcttggtttctttgttgcgcaatatcaggatgaaagtgaggatgacactgatgaagataaaaagggtgcaacttaggatgaaccagccggatttataccagggaggcagtactgtcagggtaagaatatcatagtctgctgtccagtcaccgttgcgggtactacaggcggcttttatgtgataactgcctgttggcagactgcttaagtttatttccggtaaataagaatagatgttttgtccgttcagtcctgtaatggtgtatctatacatgggtttgcggaaaatatccttatcacgggtgatgattttgatgatgatcggtttacttttttcattgacactgagttggtggtcgtttgatatccggtcgtagacacgttctccgcccactaggatgtcggccagttggagagtggggagaagtgcggggtcgtcaggtaagtgccggttgatatgtagcaagccgtttacacctcccatatagacatctccggatgaagagagcaaccggggtttctccagatattcgttttgtaccactccgtccggttcaccgaataagatgaacttcttttctttaatcagatatgcgaataacttttcttccgttcctatccatacacgtccttgccggtcacaaatgagcgagcttatttcattaatcagggtattggagacaggggtatattgctttgtacccggattataataacttaaaccatggttactgcctatccatagcaatccgttctcgtcttgtgaaacagaattgaacacggtgtctgtttgacaggtaaatataagttccagttcgttgaggctggagttgatttgatagatatgttccaaatcgtgcagatagcaatcctctcctgtgctgtttatgggtaacaatgtaccgacaatatcagtgatgccttttcccttggtgatgggaatgaattgctttttaccaatatggtatttataaggtgtttcggataacatcaaaatggtttcaggagtattttgatatacattgactgtttttccccgatggcataaaatatcattaatgctgtcgttgataatgacaagcggctgatatcggtgggtttctttatgaaagataaacaggccttggctgaatagcgaaaccagcagatggtctttgtccatgccggtgatggaagccaccttttcttcccaggtagaaagtatgtgatgaaactttccggtggccgggtcgaagaggttgatgccccctccgtctgttccgatccatatttgattgtcatggtcctgataaatggataggattgttttctcactcagtccgtaattctgtcccggcagtacgtcttgataggttttcattcctacctctttaatattgattaatccgttacgtacacttcctgcccacatattgtcgcttttgtcgttatatagacaaagaatagagttggcaggcaaggagtaacgatctcccggaatgtacctcaatgtcgatatcttgccggtctgcggattgagaatatggattcctcctccgtctgtacccatccatatttgtccgttatgctcttctaatgatagcactacattggttttgaggggagagttttgtgtatgataggtctgtaattgttttccattgcggtcataacagcttactccctgattgtaatgagctacccatacattcccttttttatcaatcaacagtgagataatctgttcactgttgaagggaacaggacgggtgttgcccgtagcgatatcaataaacagagcttttgcccatcggttggtggccaggagagtgcgggaatcccattggtaaagattggaaatatgatacttgccgttcggcttcaacgtatggaacaggttgataatatggtcttcatagttgtatttgtatagactgcctcttcccccgaagattactccgtcctcccataggcaaagagaactggctattaccggattgttgtctttatcccgcacaagggtaaacttgtcttctttttcattgtagcggaatactcccttttctgtgatggcccaaatggtatgttcttcatcttccaaaatatgtgtgacattaccgcgcagatatcttcgctgttcgtaaccgtcgaatcgtccgattcctgagcgtgtccctatccagacatatcctttttcctgactgacttccatacagcgtaccatggaggaaagtccgttttgagaggggatttgttggaaaaagtactgtttggcttctgatatagaatgcagtagagtgaatagaaggagcaaagacaggattcgtatgttgtgggcagatgttttcattgcttactcaaggtttgggaacaaaaatagttgattgtcttgaataacacaacaaaatgacgtatgaataatgcgtacaaccgataaaaagtctttttttggctgattaattcctgtctgctccttcgtttccttttattttgctatagcatcgtaaacagcttttgccatcactttcgctccttcttcattgggatggatatggtcggggaataattccggcattccatccattgcgctgtgaaggtcaatgacaggcagtttgtttttcttggcaaccttcttaatcataggtataatctcttttgagatgatatcatcattaatgctttctccggtaagatatgcctttgaaggatagcatagatagatttcaggttgtgagggaagggctttaaaggcgtcaatcatggtttgtgtatcttttatgaaatctgctttatgtacccagttgaatgacttgctgtcattggttcccagtttgataacaacgatattggggttgaacgccaatgcttgttgataagcttgttctttcatataagggcgatcacctttattcagcatggtacgtgcgctgactccaaagtttttcacccagtatttatctcctagcaaacggcctagaacggagggatagctgtcgtggctccggtttttgattcttgctccgtaagtaatgctgttgcctacacaggctacccggacagcatctttacggggagctttgaaactgcgcaaccaggcggataaatcgtttaacatctcattcttgtaaatgaagttttcgcggataccccagccatgtccgccactggcataaatatggagtacggctggtacatgattcttgtgcagccccaggtaataatttaccccattggcaggaggaactgtcttgtcatcgtcactgtaggcgataaaggcgcggggagtttctttggttacttgtttttcattggaaaattcggtttccagttcggcggaagcgtccttacctaaaagattatcgtgagatcctatgtgagtataggatttatccatggtgatgacaggatagaacaggatttgaaagttagggcggagttcggggcgggcatgtgtggcgatggttgaagctagatgtcctccggcagaggagcccattatacctatatcatatggattcagattccatacatcggcactgtcgcgtgccattttcatggcagcttcggcgtccgagatggggagagtgcggtcaccatgaggcatccgatatttcagtacaatcagtgcgatgccttgtttgttgaagtaaggtgcccagtcatagccttcgtggttgacagccagtccgccatatccgccacccggacaggctactatggcacggcctgtcgccagttcgggagccggaaggaagacgcggagtgaaggggtgtcaatatcaaatggttggggagccttttgggcggccaagggaaaagatgctgataagaagaacagcaggatcgttaaaatagaaaattttagtttcataatatattgattaatggataaaaacatatttggagatacaaagatacttgtttttatatttgggttggttgtcattgtccttaaaaaaacaatggccgggtttccgactttgtttattactcctctaaaattgactatttctcggtgaaatggacctttttagctaattttggacttaaaaatagtgattattgtaccccttatacttctgttttcctctacatttgccacagattaaaataatgttaactatcataaattactaatttaaatttaattctatgaagaagaacctctttaacgtttttctagtgtgtgtcttctgtgtggcagcaattccagatgtgtttgcccagcagataaaagtaacaggtaaagttactgacagtacgaacgaggggatgcccggtgtgaatgtacaagtgaaaggtacagccacgggaaccattacagattttgatggcaattattctattgatgttcctgactccaaatctacattagtgttttcttttattggctatgtgacccagcaagtgccggtcggtggaaaaaaagtattgaatgttcagttgaaagatgatacccagacattggatgaagtggtggtagtggcttatggtacggcaagaaagagtgatttgaccggtgctaccgccagcttgcgtccggatgctaacgatgcttctaaaacagcttcttttaataatctgttgcaaggtaaggtggcggggctgaatgtaacttcatctatggctgctccgggagctgccagttctgtgacaattcgtggcgctaactcattgcgtggagataaccagcctctgtatgttattgataatgttccgcaatcttccactggggaatttgcagagtcggctatgggtggcggtgatttccagattgcgcaggatcctttaagtgctttgaatcctgcggatattgaagatatcactgtattaaaagatgcctcggctacggcaatttatggttcccgcggtgcgaatggtgttattatcattacgactaaaaaagggaaagcaggtaaggctaaagtaaacgtgactgcaaactttaccattgcggatgcccgtaacctgcataatatgttgaatctggaacagtatgctgcttatgccaatatgaaggctaatgccggcgaggaaaagtactatccgcaagcaaatggcgagatgcattatgtgtatggtgaaaacttggataaatataaaaaagatcctaccaaccctgaatactatcgtgtcttgagttataagaactggcagaaagaagcttattcatctgctttctctcaagtctattctgtatcggtcagcggaggatcggatgcaatgacttattatgtttcgggtggttttaaggatataaaaggtattgtgagcaatacaggtattaaacaaggtgatttgcgtgcaaaccttacggctaacctttcaaagtccgttactatggcgcttgctttgaatggatctatcaaacaaaatgatatgatgaccgggggtaatacgacaggtggtattgccggttcattggcacgtacagtattggatacagctccttatgaaattccggcagacgacccgacattacaaacggacatggacgcaaaaactactgtttatagctggcgggatgactatgatgatataacggatgataaaagctttggcggtagtctggatttgaaatggaatatttgcaaatacctttcgtataatcttcgtgccggaggaaatgtgaatataaacgaacgtgctcgttggtatggcatgcagctcactatcggtgctaatgatcaaggtgtgctagccatggctaatttgaacaagaccaattataatatagagaacttattgaatttaaatattgacttggcgaaaggtattcatctgggagcgactgctggtgtaacttatgacggacatacattcttgaataagaatgtgaagggtactcgtttctctaattttgacttacgtacaaaagggttacaccttgcttctgtgaagactcatgaacaacctacccaaaaggattatcagttactgtcttatctaggtcgtatcaatctttctgcttatgataaatatttgcttactgcatctgtacgtgcggacggatcaagtaaattcaaaaggggtaaccgatggtcttacttcccttccttctctttggcctggcgtatggagcaggaagagtttatgaagcacattaactggttgaatcaaatgaaaatacgtttaggttttggtgttacaggcaatcagggcattaatccctatgctactttctctgattattcacaaataatagattatgcaaaagcgacaggggatcagattttggcaatggcggtaagcaatttgcagaatgacgggttgaagtgggaacgtacatcttcttggaatgtgggtcttgattttgcttttttcaacagccgtctgtcaggatcagtagatgtatatcagaaaaaaaccaatgatttgcttatttcgcgttcattgcctgcttccagtggttttgcaagtgtgatgttgaatcaaggttcgttgaaaaacaaaggtgttgaaattagtttgaatggagatattctccgtaacttgaatggttggagttggagtttgggcggaaacattggtttcaataaatcaaaaattggtgacctgggttttgcaccgacagattttggaaccttgaagaatgtgcgtggatatcagggaacttctataggagatcattttggtattgctaatcttttcattgcaggtgaggcaccgggattgttcttcggatataagactcaaggtattattcagccggaagatattgtagatggaaaagttgcttatacggctgctgacggatcaaccaaatattattccagttctgtggccaatgacttgggagccggtaatataaaagcggtggatatgaatgaggatggtgttgtggatgaaaaggataaaaccattttaggcaatccgaatccggactttacttatggtttccaaactcgtattgcctggaaagacctgtctgtttcggcttcttttaatggtgtgcatggtaatcagatattgaatacgaatatccgttattatacgccctctcggcaagctggtaatttgacacaagaagcattccggaatatctggacggaagagaatcattcaaatctttatccgtcggctacggcgaatgtaaagaacgtggtttatgaccgttatattgaggatggaagttacttgcgttgttcggatatcactttgaattatacattgccaaaatcttggatgaagaaaatcggctttcagaatataggtgtatttgcttcggttaaaaatgcatttgtcatcactaattacagtggatacgatccggaaatcaattcgtttgcttttgatggattacgcccgggcattgatatgaatgcatttccaagccaacgttcttatgtctttggattaaatgtggccttttaaatagtttaaccgataattttttttgtaaaatgaaaaaactaaaatatatatttttattagcaggtgctttgtcattggcatcctgtgaatcgtggctggatgaagacccgcaatatacgataaatacaaaaactcagtttagtactgtggaaaatgccagacaggctttgatgggatgttacggatatatgtcggctgataatgcttatggccaggcatggcaggaagtaacatttggatattgtggttttggatggtcacaaacgaatggcagttctacagatttattggtctctatggacggaggaattgatgaaaccataaacacaatggcgtggagagggatgtataaagtgattggtgaaacaaatgcattcattgccaatattgccgatagtccgttagaatcggctgataaattgccaatggaagcggctgctcgttttttgcgtgcattggcttattataatttggcagttacctatggagatgtacctttaaagaccactccctctgctcatgacggagtagctgttcctcgttctcctaaaaatgaggtctttgaattggtacgtactgactgggagttcgcttatgagaatttaccggaaaaagatgatgacggttttgcaacgaagtgggcggcgaaagcgtatttaggaaagctctatcatactttgggctgtcagggtgataatacggcttgggagaaggcgaaagcgtgttttgatgaggtaatgcctaaataccggctggcggataaattcagtgatttgtttgttgattacgtacaaggctctccggaatctatttttcaattgaattttgcacttgcaggttctaccacccgtaaccggggtagctggctggtcgctcctaatggctcttgtaatgggcaggcttgggaccgcatacgtgcttcaaaagctttgtatgattattttttggctacttatcccggtgatccacgtattgaaagcacattcctgacttattggaagtcttatgccggagtaggaaaaggtgagaaacctaaagaggagcctatagcttcggcgcgcgatactgtatatgcctatccttattttacatataccattgaaggagaagaaaaacctgccggatggaagaaacccaagttgtatgtaggacggattccttacgagaaattagctgatccggctagtccgaaagctgaagaactttatgctatgattgccgatacggctactgcgactcccgctgaaaaagggtatttgaaaggcttgttgtctttgttggaaaatgcgacaaaaaagccatctaccaatacaaagtcatggccctatttcaagaaaccgtgggatcctgagcagagtggtaataacagtcataagaatttaattttgtatcgttatgcagatatgttgctgatggcagcggatgtatataatgaattggggcagactgacaaggcgataacattggccaatgaggtgctgaagagagcgcgtcaatcaggaaacgcgtctcagccggctgactggaagagtggcttgtctaaggaacaagtgcgtgagaaaatttattttgaacgtattttcgaaggtgccggtgaaccggaaatgtatcagaaaatgcgtttacgtggcacagagcttttgaaaaaagctttcgaggtcaacaatgggcatggaattattcaagaatcagtggccaataatcctaaagggaacgggaactggggagaacgtatttttaatgatggaaatttgaatgatgaaaacttcctgaagaaaaatttattgctcccggttccgaaagatgagatagataccaattctgctcttgattatagtgataataattatggttatactaattaagaaaacatgatagaacgctttattcaataggtctttattggatttttccggatgcagggcgcacctgcgctttgcatccgtttttttcttgtctgtaacctgtttctggacattctcggatataaaatagtcatttccagacaagaaacaataacataacttgtatctttgcggatgttaattctttgcttatttaaatttatgaatatgaacaacctacaatcaggattacttttttctttgaccggcatcactgctgtggcatctttgtcatcatgcgcttcacaaaagaaaactgaggagcagaaaccttacaacatcgtgtatataatgaccgatgaccatactgcccagatgatgagctgctatgacaagcgttatatggaaacgcctaaccttgaccgcattgctaatgacggagtgcgttttactaacagttttgtggccaattcattaagtggtcccagccgtgcctgcatgattaccggcaagcatagttgtgctaataaattctatgataataccacttgtatatttgatggttcgcaacagacttttccgaagctgctgcaacaggccggataccagaccgcccttatcggaaaatggcacttagagagtctgcccacaggtttcaattattgggagattgtacccggacaaggtgattactataatccggattttattacgcaagacaatgacaccattcaaaaacatgggtatataaccaatatcattactgatgatgccatagactggatggagaacaaacgggataaagacaaacctttttgtattttgattcatcacaaggctattcatcgcaactggctggcagatacttgtaacttgtctttgtatgaagataaaacttttccgttgcccgataatttctttgatgattatgaaggacgtcctgcggcagcggctcaggaaatgagcatcgtgaaggatatggatatgatttatgaccttaagatgcttcgccccgataaacaaacccgtttgaaggctctttatgaaaattatatcggacgtatggatgaggggcagcgtgcggcatgggataagttttatggtcccattatcgatgacttctataaaaagaatcctcagggtaaagaattggccgattggaagttccagcgctatatgcgtgactatatgaaaacagtgaaatcgttggatgataatgtaggtcgtgtactggattatctgaaagaaaagaatatgctggacaataccttggtggtttatacttcagaccaaggcttctatatgggagaacatggttggtttgacaaacgctttatgtacgaagaatccatgcatactccgcttataatgcggttgcccaaaggttttgacaggaaaggtgatattacagaactggtgcaaaacatagattatgcacctacctttctggaattggcaggtgctcctgttcccgaagatatccaaggtgtttcgttgcttccactgttgaaaggagaaaaacctgctgattggcgcaaatcattgtattatcatttttatgaatatccggcagaacatatggtgaaacgtcattatggtgtacgtacagagcgttataaattaattcatttttataacgatattgatgtgtgggaattgtatgatttacaggcagaccctacggaaatgcataatctttatggtcagaaagaatatgaaccggttgtgacggagctgaagactgaattggcaagattgcaggagcagtataaggatccggtacgcttttcacccgatagagacaaagaataagaaaaatagcatatatcatgaaatacacctgtttgattttgctatggtcgttatttgcgactatggccttacctgctgacaacctaatccaatctatatctattgttccctgcccggagagtattactccgggtacaggttattttactttctccggaaaaacagactttacggtagaaaatgaggagcaggcagaggttgcacgctgtttctctgctctttttacccaggcggccggatttactccttgtgtgaaggttggagaaaagaaggggaaaatcagtttcctcaccgatgacgcattaaagagtgaggcgtatcatctggaaataactcccaggcagataatagttaaagcttcagatacaaaaggttttttttatgccttgcagactattcgtcagttattgcctgcttccattgagggcacagcggtggcggaaactgcggattggagcgtgccggctatgacaatcaaggatgaacctcgtttcggatatcgtggattgatggtggatgtggcccgcttttttattccgaaagagaatctgcttcgtattatcgattgtatgggaatgttgaaaatcaataccctgcatctgcatttggtggatgataatggttggcgtattgaaataaagagatatcctttacttacggaaatcggttcacggcgtgtagatcgtcctggaaaatcttttccggagcgtcgtaatccccggcagggtgaaccgactgtagaaaaaggattttacacacaggaagatatccgtgagatagtggcgtatgccgcccgacatcaggttgaagtgattcctgaaattgaaatgccggctcatagtaatgctgcgttggcttcttatccgttgttggcttgtcctgtggtcgataaatttatcggtgtccttccaggattgggaggaaatcatgcggatgtgatcttctgtgcaggaaacgatagtgtgttcactttcttgcaaggggtgattgacgaggtggtggagctgtttccctccaggtatattcatttgggtggggatgaggctcggaaaacgcattggaaggagtgtccgctttgccaggagcgtatgcgacaggaaggcttggaggacgaagaagcgttgcaaggttattttatggcgagaatgagtaaatatgtacaaagcaaagggaaagaagccatgggctgggatgaactgaccaatacccggattcccgacggagcaattatttatggttggagaggctacggtcaggctgccgtcaaggcagcggagcaagggcataggtttgtcatgactcctgcacgtatcatgtatttgattcgttatcagggaccgcaatggtttgaacctttgacctattttgggaataatacattgaaggatgtatataggtatgaaccgatacagaaagaatggagtccggaggtacgttccttgctgatgggagtacaggcttctatgtggactgagttttgcaataaaccggaagatgtggaatatcagctgttccctcgtctggctgctttagccgaagtggcttggacacagccttggcataaaaattggagaagttttttggtggcaatggataaattcaacgagcatctgtctgctaaagggattgtgtttgcctgttccatgtataatatacaacatacggtaacccctgtaaatggaaagctacaggtgaaactggaatgtgaacgtcctgatgtggaaatccgttacacaatggatggtaaggagccgacagaccggtctccgctatataagagcccgttgatggtgaccggtacacaaactataaagtgtacgacttatagagcaggtcggcagatgggaaaaacattgacattgcctttggtctggaataaggctaccgccaaacctgttttaggaaatacacaggccgggaagattttagtaaatggtatacgtggcagcttgcgccagtcggatttcgaatggcattcatgggaaagcagtgattctgtcgcttttactatagatttgcaaaagaaggagtcgcttcgttctgtatcagtgggatgcataacgaattatggcatggcagcccataaaccggcagatattgaagtgtgggtttcaaatgataatcgggattatcgtaaagtatccggtaaacagttcacggatggagagattttccgtgaagggactttcaaagaggatgtggtacttgatttgaataaggaaattggccgttatgtgcggattattgctaaaggagccggagagtgtcctgcaacccatgtacgccccggacaagaggcaaggatttattttgatgaggtaatgatagaataaatagatatatgagaaatacattattatattttttggctgctctggttatatttccagtaatggcgcaacaacaacccgaatggcagagccaatatgctgtcggactgaacaaactggcccctcatacttatgtgtggccttatcaaaccgtatctgatatccgtaacggagattatgaatcttctccttattacatgagtctgaacggtagttggaaattccattgggtaaagaatcccgataaccgtccgaaggatttttataaaccggagttttatacaggaggatgggcggatattcaggttcccggcaattgggaacgtcaaggatatggaacagctatttatgtaaacgaaacctatgagttcgatgacaaactgttccattttaaaaagaatccgcctttagttccatataaagagaatgaagtcggttcctacagacgtacctttacaattcctgccgattgggaagaccgccgtgtggttatctgttgtgaaggagtgatttctttttactatatttgggtgaacggacatctgttgggctataatcaaggttcaaagacaccggccgaatgggatatcactgataaattgaagaaaggtgagaatacggtggcattggaggtttaccgttggagtgccggttcgtatttggagtgccaggatatgtggcggttgagtggtattgaacgtgatgtgtatctttacagcactcctaaacagtatatagccgattacaaagtaacctcttctctagacaaacaacaatataaagaaggtattttcggtttggaagctaccattgaaggaccttctacttccatgactacctttgcttaccgactggaagataaaaccggtaaggcggttctgcaaggtgaatatcctatcaaatcgaagggattgagccatttcttgaagttggatgaacaaagtttgccggatgtggaagtctggagtgctgagcatccgaatctttatacgctgatcctggaattgaaagatgtaacaggtaaagtaacggaacttaccggatgtgaagtaggtttccgcacttcggaaattaaggacggacgtttttgcatcaatggtgtgccggtcttggtaaagggaacgaaccgtcatgaacattcccaattaggacggactgtaagcaaggaactgatggaaaaagatatcaaattgatgaaacagcataatatcaatacggtccgcaattcgcactatcctacccatccttattggtatcagctttgtgatcgttatggactttatatgatagatgaagctaatattgaatcacatggcatggggtatggacctgcttcattggccaaagattccacttggttgcctgcccacatggatcgtacccaacgtatgtatgagcgttccaagaatcatccggctatcgtcatctggtcattggggaatgaagccggaaacggtattaacttcgaacgtacatatgactggatgaagtcagtggagaaaagtcgtcctgtacaatatgaacgggccgaacagaattataataccgatatctattgccgtatgtatcgcagcgtggaagaactcatggcctatgcccgccagacagaacctaaagtctatcgtcctttcatcatgacagagtatctgcatactatgggtaatagtggcggaggattaaaggaatatatgcatgtattcgaaaccgaaccgattgttcagggaggttgtatctgggattgggtggatcaatctttccgcgagatagataaggatggtaaatggtattggagttatggtggggattatggtccgaaggatgtgcccagctttggcaatttctgttgtaacgggttggtcaatgcagcccgcgaaccgcatccgcatctcattgaagtgaagaaggagtatcaatatatcaaatcggcactgaccgatcctaagaagctgacagtggaagtcaagaactggtatgactttaccaatttgaatgcctatacgttgcactggcaggtcatgggggatgatgggaaagtgatagcagaaggaactcgaaaagcagactgtgcccctcatgaggctgtaacattctctttgggtgctgtaaagttgccttctacgattcgtgaggcttatttgaatctgtcttggacgcctgataaggcaactccctttattggaactcatgacgaagtggcctatgaccagtttgtactgtctgccaacaaagggtatcgtgcgccggaaatcaaattggctgataaggtgaagatagatattgatcctgcaaccggtgctttacgctcttatatatataaaggtaaagagatgctttcatctcctgtagttctcagcctttatcgtcctgttacggacaatgacagcagggaaaaaacaggaggagccaaagtttggaggaaagaaggtttggataatatgattcaaaaagctacttttgtcaaagcatctgaaacaggtggtaaagcggaagtagaattatggaatgctaaaggcgtaaagttgggaatggctacctttgtatatactttgcagagcaatggtgtattaaaagtaaagacaactttcctgccggatacttctgctgttacttcattggctagagtgggcttggcatttgaaatgccgtatgcctataacaaggtttcttatttgggacgtggtgaacatgaaacttatatagaccgtaatcagtctggatgtattggaatttaccatacagatgcagaacgtatgttccattattatgtgaagccccaggctacaggaaaccgtacggatgtgcgttggatggaattggcggatgaggcaggagaaggtttgtctttccgttcggataaagtgtttcagttcagtgttattccatttacggattctaatgtagataaagctactcatattaataaacttgagagaacagggattataaatgttcacttagatgcggaacagtcgggggtaggtactgcgacttgtggtccgggggtattgccgccatatcgtgttccggtggagaagcatacgtttgagtttatgattcgtccattaaaataacctagtaataaagaaaaatgagaaaaacgattctaaccgcagccttactttgtgcttttctgggaactcaggcacaggagtattatgagaaacacgtagcttttccggcaggagcgactacggaacagaagatagatatggcttcccgtttggtgcctacaccgcaacagttggcatggcaacaaatggaattcacttgtttccttcattttggtattaatacctttacaggccgtgaatggggagatggtaaagaagatccggccattttcaatcctaccgaattggattgtgaacaatgggtaagagctctgaaggaaggtggcttcaaaatggctatcattactgccaagcatcatgatggtttctgtttgtggcctacccggacaaccaagcattctgttgcttcttctccatggaaaaacggaaaaggggatgtggtacaggaactccgcaaagcttgtgacaagtatggattgaaattcggagtctatctttctccttgggatcgtaatgcggaatgttacggacaaggagaagcttataataagtttttcatcgaacagctgactgaactgcttaccaattacggagaagtgcatgaggtatggtttgatggagctaacggcgaaggacctaacggaaagaagcaggaatatgattgggacgctattttgaagactatccgtcgtcttcaacctaaggcagttaccgctatcatgggcgatgatgtgcgttgggtaggtaatgaaggtggattgggacgtaccacggaatggagtgcaacggctttgatgcctaattcttatccgggttctgatgaagtctataagagattgggcataaatgctatgtccaaggatttgggaagccgtgaattggtatctaaagcatcggatttgttctggtatccttctgaagttgatgtttctatccgtccgggatggttctatcatgccgaacaggataatcaagttcgttcacttgccaacttggtgaatatttattatcgttctgtgggttgtaactctgttttgttgctgaatattccacccgataaacgtggtttgatgcacgagaatgatgtgaaacgtatcaaggagttgacggaatatataaaaaagacctttgccgataataaagttgagaagggaaataggatatggacagccaaagtaggagatacgaaagaatataaggtgaggaagaatacacttgttaatactttcttaattcaggaggatattacaaaaggccagcgtgtggaaggttttacagtagaagtgttcgccaatggcgcatggcatcatgtgggtgagggaactacggtgggatataaacggttgttgcctttctcggatagtcatgccgaaaaggttagagtgacaattacgggtgctcgtggaaccgtcaatatcagtaacataggcttgtattatgctgaaccattggttgataaaacgatgaaagtaaccttgagtgatgtcccggtggatggttggaaaacagtgggcatggatgcagccgcagccatcgatggaaaacaggaaactgtttggaaaaccgaaactttaactcccttggtggttgatatgggtaaagaagtggaaatagccggtttcagttatgctcctgcacaggaggaggatctgactggcactatctataaatacaacttttatgtcagccgggatggtaaggattggatgaagtgtgacgctacaggtgaattcagtaatatcatgcataatcctgttccttattttgtacgtttcggaaagacttatccagcccgttattttaaactggagcctgttaccgaaataaataacaaagcagtaactgctgtcggtgagataggagtattgttgaaataaatcaggttaatatatttttttattttaggagaagttatgtcaaaagtcgggtgagagaatcatctgggttttgacgtaacttcttttgtatatggagggcatattaaggaattagctaataatctgttaagagctttccggattttgagaaaacgtattatatttgcataagcataacagatattcaactttttgattaattgtagaaagcctttgtttaatcgatatcacttaaatgagtaaaatatgaaaaaaagcttgtactttctttttatattagccttgttctgtttgacaggctgcaaggatgcgcttgttccgaaacctataaagctcacttgcaatatcaatacatttgacgctcctatatcatgtatcagccgttcgacagcagatgcggataaactttatattggtcaggaagacggttgtatcatagaaaaagtgaacaataattgccagacctattccattaatagcaaccggcgtatatatgatatattggaatatagtgaagattctctgtttgtgggaacaagagatgccggtttgaaactattggctaaatcctctcggcagacccagacttactacataaaaaataagaggatgaattattcggtatatagtatggctctggatgatgacaaacagtgtttgtatgtggggactagtaatggactgtttagattgaatttgaaagatggttccacatctcatgaactcactcccattcaactagggaaatgtagtaaaaactgtggggtgaataaggttgtgataaaggaaaaaaaactatatgtggctagtgaacaggggttgtttgttgtccgtaatcttgaaaaggactttaaacgacctgttatagattctctggttaccaatgtcagtgtttataatgatacagtatatgctttgttggaaaattcggtttttaagatatctcccgatggaaaaaagacgcttgtacgcaaaggacggtgctacttgtatgctcaaggacccgacaaggatgaatggtttatcagtgctaattctatactttatgtcaaagacggttgcactttagaatatgatttgccgaatggtatcagtactatcgccaggcagataggctttatggggaaagattttctgcatctggcatgcagagaggctatgctttcttttgccttgcgacagaactcggcagatttagacaataatgtattggcggttagtgataaaaggacgggagactccattttctttattaccgatgatcttcgtttacatctgtataagtttgtctataatcatccggaattcaaatcaaagtctttaggaaagattgaaggcttggatattgtgggtaatgatattataaaatttttggaaaccagtcctaatactttctttcttgctacgcgtaagaaactttataagattaaaggcaatagagcggagtgtcttttgcagttcagtaacacgaaagggcagaataatatcacttctctttattattccaccgcggaacattgtctttatgtgggtactagggaatatttaggtattatagatgaacagcaggaccatattgtaactcctattccggttgtgtcagataaaggggtgaaagatactatcgacgcttatattaccggaatttgtgagaatgaggatagtatttatgtaacgaccttgaacaaaggattgtatggaagacctttaaacaggccgcaggaatctttctggcagatacgtgatttatcagggtatgagagtgtttatggtgtgataatgaatggtagaaataaatatttgaatacctcgttgggaatcgttaatgaagaaaatgcgaccttgttgccagtgaaacatgtgaaatcaatatcgggagctcttgaaaagaatcctaatgagggctttttcatactctattattatggtatgagttttaagggattggatgatgccggtgtcccagaaccattattctgcgatttggcttttagcaagtcttgtattgccgtcaatggacggaaagcggttttgggatgtaagtcaggattattcctttttgatggtaaatcaggcttgcttcctatctcgatagaaaaagaagagatgtcctatgcgctgtatatcatcctgtcaatagcggtgctgctatcggcttttcttgctcttttccttttgaaaagacggaaaaaaggaactcggaaagcgctgatggataaaaaagggataaatccggatgatgtcgggatgaattgggaggaactggaaatggacgttcataaggttgacaaaaaagtcaagaccctgtttgatgccttgggatacagaaaaacagagggagaggatgatatgcgtcaagaactgaaacaggtgtgtttggattttgctgacaaatatcctgaattgggtaaattatcctttatgaaacgaaggggaaaagaaaggtattttataacgatacttctgatgatagaagatattgatgctgctattatttcaagagtgctggatgtggatcaggcaacggtaacaagacataagtataatgtaaggaaagaaatagaacaactttatcctgatggggagtttgattgtaaagtcatcaatctgctttatgaccgtatcaattcaagaagaaaataagttcatctttagagttatctcaatttattgtatttcgtagagccggcttcgtgtatctgttttgttatgaggaatggcttttttgccggaagtgctgaaacacttccggctctcctttttttctccttttctcttctaggatgttttggtcatataaaaggaggaaacgggattaaaaaggtattttcgggataatttcaaacactacttttgtttccgtcagatgcggacactctgattgtttgtcgtacgttccgtagatgattaaaatatttttcgaaaaaccaattgaattttattaattaaccgtttaaactaaacttttatcatgaaaacaaagtttgccttacttctagtgttttgtgccatttcattaaacatctttgcacaagagaaaaaaataaaggatagaagaaccaatcccgaactttattatttggaagaatcggaggttgccaatagtctggagttactgcctcctcctcctgaagcaggaagtattttgttcttgtatgacaaagcccgttacgactgggggaaattgcaaagggatactcctaggggtgaacaagctgtcagtgatgcccgtgtaaatggtgatggcgttccctttgccttttcggaggcttttggtattgaaataacgagggataaaacgccggaactgtataggctcattattaatatgagagaggatgccggagatttggctacccgtcatgctaaagagtattatatgcgtgtacgtccttttagttttttcaatgaaatgacttgtaatcccgaacagcaggaagaactttcaacgaacggttcctatccttcgggacatacagccataggatgggctactgcccttgttttggcagaaatcaatcctgacaggcagaatgagattctgaaaagaggatttgaaatgggacagagtcgtgttatttgtgggtatcatttccaaagtgatgtagatgctgcccgaattgtggcgagtgctgttgttgcccgtctccatgccaacgatgcttttgtgaaacagcttaataaggcgaaagatgagttctccaagctgcaaaaagcaggactcattcagtctgtttccaaaaaataattccctataacttaaccataaaccgtaactatttaatgtaatgtttttcttagatgaaccggacaagagtatttgctgagcctaaaagcatgactattgatcggatgctgatggaaggaggagtctgactgattgctttcattgtgtggtcttacagattcttcactgccctcagtatgataaaaatcagagacagactgacaggatacttggatggttaccattaaaactgtatattatgaaaaatcttatatcattaggagtttttctcctgatattgctctccgtacaggtaaatgcacaggaacaatcagttttgaaaatacgtcctacaggacgaatcttgatggatggaggcttgtttcattcagataataaaaactttgtagatggtgtagcgattcctgatgcccggataggtgtaaaagcaacctatggaaaatataaagcgaaagtggatataggctatgcgtatggaaaggtcagtttaaaagacatatttgtagaaagacaattttcctcacatgcgttattacgtgtagggaattttgtacatcagttcgggcttcaaagttctactagttcgtctatgaaagtaaccatggaggagccggcaagtaatgaggcttttttcaacagccggctgatgggggctatgtttgtgtatgacaaaaatgattttttcggtacagctagtgttcatgtggagagcgaggctcttaagaagaaatccaatgaattgggtaaaatgggttatggtgctatgagccgcctggtctatcgtcctttacatgatacagggagattgtttcagttgggtatttccggtgcttacgaaacacctagatacaatagcgaacctacacttaaccatactagctttgacttgggggctaatttcccgacgcgtattgcaaaagtcagagctgtgaatgccttgattccggatgcaaagaacttgataaaatttacaccggagatgatagcaggatatggtcctgtggtattggaagcacaatattattatcttcaagtgaaccgggaaaaggattttaagaattataaagcgagtggtatgtatggaatattgagaggtttgctgataggtggtaattatagatattcacatacggattgtggtattgccactccggactctggttcgttggaatgcgtattcggatataactatactgatatgtcggatacccggtcccatatttatggcgggcgtttgaacgatgtctcttttactgtcaattattatatcaataagtatatgatatggagattccggtactcttatactaagataacggatagagtgggatttgaaaatcagtcattaagtgcgtttcagacacgttttcaagtgatattttaaatagagggtcagagtttcattttgtttcaagagtttgaagcaaggtggaactcttatatttgaaacagattgggtggcaagaagaatgtccttttgggggtagagggtagcataaacctgttactgtaagaacgaatattgaaaaatagctttatctttgtattctttatactaggaattaaatgaaaaacaaatgaaagaagcaaccataactccttttgcaaagccgctatatataatgaccaaacctgtaggtgcggtttgtaatctggcctgtgattattgttactatttggaaaaatccaagttatatgaggaacagccgcgtcatgtgatgagcgatgaattactggagaaatttattaaagaatatattcagtcgcaaaccatgccgcaagttttgtttacctggcatgggggagaaactttgatgcgtcctttagttttttataagaaagccttggaacttcagaaaaaatatgcaggtggtagaaccattgataattgcattcagacaaatggcacattgctgacagatgaatggtgtgaattcttccgtgagaataattttttggtaggcatttctatagacggtcctcaggaatttcacgatgaataccggaagaacaagatgggacaaccttctttctataaggtaatgaaagggattaacctgttgaaaaagcatggagtggaatggaatgccatggcagtggtcaatgactataatgcagattatccgttggacttctatcgtttctttcgtgacgaacttgattgtcattatatacagtttactcccattgtcgagcgactgtctagccgtgcggacggtcttcggctttcttcattaaagcaaaaagacggtgaactggctcctttctccattactcccgagcagtgggggaatttcctttgtactattttcgacgaatgggtactgaatgacgtgggcaattactatattcagttgtttgattctacgctggccaattgggtgggacagcagccaggcgtttgttcattagctaaatattgtggacatgcagccgtgatggaattcaacggtgatgtgtatgcttgcgatcattttgtctttcctgagtataaattgggaaatatttatcagaagactttggtggagatgatgtatggtaaagaacaggaaacttttggtgtgatgaagcacaatagtctgccacagcagtgcctgaactgttcttatgagtttgcctgtcatggggaatgtccgaagaatcgttttatgttaagtaaagacggtgaaccgggattgaattacttgtgtaagggatattatcaattctttgaccacgtagcaccctatatggattttatgaagaaggaatatctggcggaacgcgctccggctaatgtgatggagtgggcgagagaaaggagaaataaatagactgttttcagtaagccgactgtatggaacaagcaagtcaacttacctggtcgtttcagttgacttatttgatcatttaagttaagttactttttcatggctgttcggcttagttggaaaaataaaaggagcaaagtctctacgacttcactccttttattttttccggtcagatgaattattttccgttgtattcatcagatacagttaatttcttacgaccttttgcacgacggctggctaatacgcgacgaccgttagcagttgccattctttcacggaatccatgtttgttttttctctttctgttagagggttggaacgttcttttcattgtatatacttattttatgttattattcaccatgagtaacgggctgcaaaattagtgacttttttgaaataaacaaagagataactcatttttagtgatttctttttgcgttttttcttgatttacattacttttgcactcgaaatcacagctataagtgaatataatctgaaataataatcaaatataagcgaagaaaagtatgattaatgctcaagacattaaaatcggaacagctatccgtatggacggcaaattgtatttctgtattgacttcctgcatgtaaaaccgggaaaaggtaacacattcatgcgtactaaattgaaagatgtggttaatggttacgttttggaacgtcgtttcaacatcggtgaaaaattggaagatgtacgtgtggaacgtcgtccacaccaatatttgtatatggaaggtgcagactatatttttatgaatcaggaaacattcgaccaaattcctattgctcatgacttgattaacggagtagacttcctgttggaaggaatggtggtggatgtggtttctgatgcttctacagaaacagtattgtttgctgatgttccggtaaaagtgcagatgaaaattacttataccgaaccgggtctgaaaggggatacggctaccaatacgttgaaacctgctacagtggaatcgggtgctaccgtgcgtgttcctttattcattaatgaaggtgaaacaattgaaattgatactcgtgacggttcatatgtaggccgtgtgaaagcataatctatttatatatgcatataaaaaggcggaacttgttgcaagctccgccttttttatgtttctttgtacttctctgtgatggataaaatcaaaataaagcaatgagatattcttttattataccggtttataatcgtcctgaagaggtggatgagttattgaacagtcttacaaggcagacaaataagaattttgaagttctgatagtggaggatggttcatcagttccgtgcaaggaagtggtagataattacgctgaccggttggatatatgttattatttcaaatccaattccggtcccgggcagacccgcaattatggagcggaacgggggcatggagaatatcttatcatattggattctgattgcattttgcctgaagggtatttggcggctgtcgagtcagagcttcaacggcagaaggcagatgcttttggtggtcctgaccgtgctcatgattcgtttaccaatatacagaaagcaataaattatgccatgacttcgttttttactaccggaggtatccgtggagggaagaaaaaaatggataaattctatccccgtagttttaatatgggggtacgggctgaggtatataaagcgttgggaggattttctaagatgcgttttggagaagatattgatttcagtatccgtatctttcaagggggatatgcttgtcggttgttccctgaagcatgggtgtggcacaagcgtcgtaccgatttgaagaagtttttcaagcaagtgcataattcgggtattgcccgtatcaatctgtataaaaagtatcctgaatcattgaaagttgtacatttgttaccggcactttttactataggaattgtattcctgttgttatgttcgttggtttgtagctggagtttgtctttgctgctgctttttgctcttatcatttgtgtagactccacattgcgaaataaaagtttcaaaataggattattatccatccttgcttcttttattcagttgattggctatggaactggtttcctgcgggcctggtggaaacgctgtgtgttggggaaaaacgaatttgccgcatttgagaagaatttttataaatagaattttaccatgaagaggtgttaaaagtgatggactttttatgcgtctttatggcggggaaaataaagaaagatggcagaaaaactaaccataaaccaatgggcggaagaagatcgtcctcgtgaaaagatgatgttgcatggagtggggacactttcggatgctgagttgcttgctattctgataggttcgggaaatacggaggattctgctgtggagttaatgcgtaaagtgttgagtgattatcataatagtttgaatgaattgggcaaaaccaccgtagatgaactgtgtcactataaaggaataggtcctgccaaagctatcaccattttggcggcttccgaattgggaaagcgccgaaaggaggaagaaggaaaagaacgtaaggtcattctcagctcccgtgatgtttatcaatatttttatccgttgatgtgtgatttgcctacagaggaatgctgggtattgttgttgaatcaggcttccaaagtaattgaccgtataaagataagttccggaggcctggtctctacagcggtagatgtccgttgtgtattgagggaagcattgttgaaacgggccgttgccatggcactttgtcacaaccatccttccggcagtatgcgacctagtacagaggatgatcggttgacggaacatcttgacaaggcggcaaaagtaatgaacataagactgatagatcatgttattttaacggatggcaaattttatagctatgctgatgaaggaaaaatatagaaaatcattaaatttgcaatcgtactgtggttatcagtagtttcaaactttataattcacagataagatataatttatagaatctttccctaagcctatttcttagagtagaattcctgcttattttaatcgctttatatattctgatggagacattccatattcctctttgaagcattctctaaaataagatacggagttcagcccaacttgatgggctatttctgaaatattatactttcctgagagtaatagttgctctgccttcctgagcctcagtttacggataaattctcctgttgacatcccagtcagggcttttatttttctgtaaagagaagaataactcattgataactcctgggctattgtgggcacatctattttctcatccatcaagttttcttctatgatctttgttattctttcaatgaattcattatctattttgtttaatgattctttgatgatagattgcttaagatgggtgcttgaagatattaaggaagctatttttttccttccttctaatagattggctactctgcttttaagtaaagatgcactgaaaggtttggtgacgtaggaatcggcaccggcatcatatccttctgttttatcttgtaatgtgtctttcgctgtcagtagtattacaggaatatggctggttgcaatgttatttttaatttccttgcataactcgatcccatccttcacgggcatcatgatatcactgataactatatcgggaatacttgtgaaggcaacctggcatccttgttctccattctcagcaacaataacatcgtaagcacccatcagtgcttcagcaatataatcacggatgtcgccctcgtcttctactactaaaacgatgggtttacttgacttctcttcatctatggattctttgagattagtattgatatgtatggcatcgggataggaattattggttattagccggacacggaaggatgaacctacattaggctcactatccaccaggatagttccttcatgcaaatctactaggttttttactaaagcaagtcctataccgaatccgggcatgttttttcttatattagtttgataataccgttcgaatatacgtgagatatcttcttgggggattccaatccctgtgtcagctatttcaatttcggtgtattccacatcattagctattactgaccgcaaagcaagcgtgatggttcccttataggtatatttgaatgcattggataaaaggttatcaacaatcatggaaattacttcctggtcaaaatatatctgtattttgtctgcatcagtaatcatatcaaatgtgatatcggcatttcggttcagttctttatatttgaaaccgatttcctgaatcttttcgacaatgtttccttcaattacacataacttcttgttttgggtttctgttttacggaactccaatatttgagtgaccagatttagcaagcggattgtgcttttatgaataagagaaatcttcttcaggtgttctttttgtattcttgaatcgcattgtaaatcctcaagtggtccgagtattaatgttaatggagttttcagttcgtgagtgatattggtataaaatctcaatcgttcttcatttaattcctgctgtttctgggctttttctttttcgagtgataaggaactacgtaactgcaaacgttttttataagatttgataatgaagaatacaatagtggttatacttactatatatattaatttagcccaccaactgagccaaaacggaggattgatgctgatgaacagggttgagtagttagtctgccattcctgatttttataacgcgccttaatatgcaatttatagttacgataaggaatattgcgaaatgtaacttgattatctcctcctatattaatccagttttcctccaatccttccagtttataggcatattcaactttaccttgcagggatttgttcatgacgttaaacgttatgctgaatatattctgattatggttaagcatgatttttccgtttgtcataggtatggatgtgtcaattgcatcttcgtgagggtttctgccatagactttgaaatcggtaaatattaccggaggaagaattatatttgaaggtctgtctttggggttaaagtagcacacgccattgatactgccgaaataaatagttccgtcttgtgccttaccaactgagttgttcatatatgtaccaaatagggtaccatccttatggtcataatttaggaatctttgctctgactcgatgaaacaactgatacctgaatgggtgctcagccagatattaccttccgaatcttcttcaatggaacagattaaattgcaggctaatccgttttgggtattaaacaattggtaagtatctgactgctcattggggaataagactaatccttctgttgttgcaatccaaattctgtttttggagtccctgaatatctgattgattacacaattttcgaatatagtgtgctcatttatatgtttcatggtcttactctccggattatatatactaattcctttattgagagtgccgatccatatattcccgtttttatcttgtgagacagctttgatttcattagtcaagagttggctgttctctttattgagaaaatcttttttcttggttatcaggttgtaaatttccagtccgttgttactgccaatccatacgtttctttggttgtcttcaaagagacaatagataactgaaccatttccctgcggagtgtaatggatgaatctgccttctttgcttataaaaacatcgatccccatttcattatacatatttccaaaccataaatctccgttagaatcttttagagaagaatgataagtatttgatgaaatatctcctgtatcatgggagtaaaacatacaattcctaccatcaatgttgacattgatacctcccccatcggttcccatccatatattgccattgtcggcaacacatattgttaatacctctttgtcattaagcccattagtgacccccggtatcttattgattctccaactatgaaagaaggatgaagtgctgctgataaagctggctcctccgccgtttgaacctatccaaacgtttttgaaggagtcttcaaagacacaataaacggttggatttgatattccccaataaatatcttgaataaacatatgattaacattcttttttccggataaaatcaggtctgtatctttggagtcgaaataacaaagatcggagactgtacctacccatattcggtcatcactggtactatagacattatagatagctctttgtatcgtatagtgaattccactgacatctttgaaattgcggaatgtttctctgaagggatcaaaaagcgatagtccgcagttggttgcaatccatattttagaattggtatcaacaaatatagaatggatagtattatccggaagtgaatttttgttttgagatgaatgagtgaaattcttaaaactgttgttatccggagagaaaatagtgaatccgttataggtatgtccgatgtataaatcaccattactgccttcagccagtgtcatgatatcatttgagggaaaatcaggaactgtcgatgtattataatgtatgaactgtgaattgtcgggattatataaatctaatccttgattcgttgcaatccatacattcccgttggatgtgactagaatgtcttttatttcattggatatcagtgtgttttggttgtttttatcatgcagaaaagatgaaaattgctgtgttgcacaatcaaaaacgttcacgcccatccatctgttggcaatccataccttattattaatagtgtctgtagcaattttattaatatcattgctattaagcaattctttattgggttcttttaggtagacagtaaacttatctccgtcgaatctattaagtccatatttggttgcaaaccatgtgaagccatatttgtcttgggcaatatctgttacatagttactggataatccatctttcatgactaaattaatagtcggaatctgctggcagaaaccttctatggagtaaactactaatgagagtaataagattaacttaaatgggtcactctgtttcatctttctactatttttatcttcaaaattactatttaatctcaaacaaatacaaaaatcagtattaataagcacaatgatggtcgcaatccttccaaaagtcgcccataattctgtcattgaaaaatagcggtggtattctgaatgatacagatgcctgaagtcttgactctaatttacctttgttcggtgaaatcttttggagagctaattctccatgctatgtgaaaccttaaaatgatagcctatgagaagcacataagagttacagttctttttaatttctgcttgtgaaaaacataatgaattagtttaagtagttaattttaaatcactattattttatgaaacattttcttatttggattttcttgttttttttcgcaatgtccggttttgcgcaagatttgaatatcaaagggcaaatcacggatacatccggtgaatcgattattggtgtgaatgtaaaggtgaaaggtaaggataccggtactataacagatatagatggcaattatcatcttcaagctgctccgaatgatattttggttgtttcttatattggttttattactcaggaagtgcctgtgaaaaatagaaaggttgttaatatacgtttgatagaagatgtgaaggcattggatgaagtggtagtagtaggatatggaacacaacgtaaaactgacttgacgggtgccgttatacgagcagatattaaaacgttgaaaaggtctcccaactcaaatgtgttgcaatctttgcaagggaatgttccgggacttaatattgggcaggtgaccaattcgggaggtactccgtccatgtctatccgtggtacgaatactttgggaggaaacaaagatgttttggttattttggacggaatcatttatacaagttcgttatcttctataaatcctgatgacattgaatctattgatatcctgaaagatgcaagttctactgctgtatatggtgcacaagcagccaatggagtagttatgattaccactaagaaaggtgtggaaggaaaaccgaaaatcagtttctccagcagttatacgttttctaacccgacccacaattatcgtccgatgaatcgtgaagagtatctggataatgtcagagacttctattatacagaggctttccttgggcctgattatactactcctaatccggactttgatctagcgtctaaattgccggatgctccgttgagggatgaaaatggaaatatcagtccttataattataactggtggaacgaaggaacacaaagcgggcatttgtttgaaaaccgttttaatatatccggtggcagtaaatccatcaattatatgctttcgtactccaatacggatcaacgtggatttattgtaaatgatgattttaaaagaaacagcattcgtctgaatttgaatgcggaaatagctccctggtggaaaataggaattcagacttttggtgcatttgtgaatcaggatggtgcggagccgggtttgtggaatctgataacccaatctccattgattgaaccttatgacgcagatggtaagataaagccatatccttttaatacattggataccaatccttttatgggatcagatattgatgattacgagcgtcataattattttttcggtaatatatcatctgaaataaaattgcctcttaaagggttagtgtatcgattgaattttggtaataactataggatagacaatcattttcaggccagccagtatggatacaatctgcaaggagaggcttataaagagcataccggctactatgattatactatagacaatattctggcttacaatgctacatttggcgaacatcatattgatgctacattattgtatggggcttcggagcgtaaatacgattatacaaaggctttgggacagggatttacacgcatgacattgggctataatagtctggaacaggcaacaacgcgctatgtatattcggatgcttggagagaggctctttgttatcagatggccagggtcagttatcgtttgatggaccagtatttgataacgggtacagtgcgtagagatggtttttcgggatttgcggcgaataataaatatgcgactttcccttccatagctttagggtggattatctcagaagagcctttctttaaaataccttggattgattatctgaaactgcgtgggggatatggtatcagcggaaatcagaccagcagatacaaatctttgtccactgtggcttctgaaatcagatatatttttggtgatggtggaaagcctgtaatcggacaggagatttcggctttgggaaatagtaatctgaaatgggaaaaaacagcagggataaatttaggtcttgattttacaattctgggacaaagactcaccggttctgtagaatactattcgacaacaacgaaagacttattgtatgatgtggctttgcccgatattacgggattttcaaagatagcttctaatcttggaaaaatcaagaacaagggtttcgaatttattctcacttcgaagaatatacagacttctgattttaaatggactacttcactcaatttttcgacaaactccaataagatcgtaactttaacaggagaagataatgatggagatggcatagaggatgataacatatccagtaatctgtttataggccagcccatatctgcggtatatgggtatgtagtagatggcatttatcagttgggtgatgatatacctgccggtttctatccgggtaattatcgtattgttgatatgaccggagagggagaaataactcctgaagaccgtgtcattttaggtaaaggagatccggcttaccgatttggtattatgaatacgttagagtataagaacttcacacttagtttctttatcaattctgttcaaggaggaaaggatggatatctggcagccaactcttcttcgttggtcagagatcagaataatctgcgctggaatcgtataagtgcatgggattactggtcaccacgtaatccggatgcagtctatgcacgctccattagtaccccgaaaataactcctacggtatatgaagaccggagctttgtacggttgcaggatgtttcattgtcttatgcttttccgaagtctgttacgaacaaggttggtttgaatgaaattgatctgtttttcagtgggaaaaacctgctgacttttacaaaatggcatggttgggacccagaagctggaagtacttattcggacagaccggtaatgagaagtttttcttttggtgttagtcttacttattaatctgatttattatgaaaataaaaatatatattattaccttgttgctttcagcagtgctgggttcgtgcagcagttcttttttggatgagaagcctttggattttatgagtgcaaccaattcttttcttacccaagaggatattgattgttctgtaaataatctctattacctggtgagaagggaattctatagcagggatgaaaatcgtccgatggactacctttacggcacggacattgtctatgatggcgaaccgaacggtacggaacggcattcgaatatgatttcagcttatcattcaactggtaatattgcatcggtacactggtcattgctttatcataccatatcaacggctaatactattatcgaccgtctgcctgtttcagaagtatcggaggaacaaaaggtgattgccgaagccaaagcccgtttctttagaggatttgcatacaggaccttggcttatctgtacggtggggtacctcttttattgacggaagtcgtcgggcctaagtttgattatgtcagggcatccaaagaagaggtgttggaacaggctatttcagatgtagagtttgcggctacttatttacccagtttgtccagtgtgcaggatggagaagtgtctaatacagcagcatatcatttactctcagaactttatttggcaacggctcaatatcagaaagcggtggatgctgccacaacggtcatcgatgatccggctaccggactgatgtacaatcgttttggttccagagccaatgaagttccgggagatgtatattgggatttattccgaaaaaacaatcagaacagaggttctggaaacacagaaggaatctgggttattcagattgaaactgacacccccggtggaagtggttctttgacggctaaagaccagacatatactttggaaaggcatcatgctccgatggtacgtgacgtgaaagcacatggaatgaatcctttcagttggccgattggtgactataccggaggccgtggtataggctgggccatttcaacccgatatttcagtgatgagatatggaaagatgatttttatggagatatgagaaatgcaaaccataattttgtgagaaagtttgcggttcataataaagagtatgccaaactttacggggatactattgatactcagaatccgccggtaggggttacagttccctcacgttcgctctatgcatatcagtccaagtgtactactccatacaatcatccggaaggtttgtattccaattccaaaacttttgcgcttaacagtggagctggggctacatatacggatcaatatatgtttaggcttgccgagacttacttgctgcgtgccgaggcatatctggctttaaatgataaggacaaagcagcagctgatatcaatgttattcgcaatagggctcatgcgaaaccggtattgacatctcaggtaaccttggattatattctagatgagaggatgagagagttgggcgtagaagaaagacgtagaataacgttgatgagaatgggaaaactttatgaccgcgtgatgaaatgcaacccctattatgccaaggagatgaaaaagcattatgaattatggccgataccttataaggaaatagaagcgaatagaggagctgtgttggagcagaatcccggatatgaataaagtagataggtataatattaggcattaagaatagagggtatgttgtttttaatcattgtgtgtctgcatttgcagacacacaatcaatagtaattaaaatataatttatatgatgatgagattttggttcgtattcatatttatgtttcttccggcgatatgctggggacagattattgttaagaaaactggaggtggggcagcctttccgttagtgtcttctcatgaaacagtgatttattatgatgcccgggattatggtgtagtagaaaaaacagcttgtcttttggctgaagatataaagcgggtgactgataagaaagtgtctgtttcttctaaaaaggtttcttcggaatatgccgttgttgtgggaacggtgggacataatgcttttgttgaccgattggtggcaaaggggctattggatgtatctgccattcgtggtggttgggaacagtttgtcgttaaaacgatagatgctccggtcaaaggggtgaaaaaagtacttgtcattgccggatgcgacaggcgtggcacagcctacggcgtatttacattgtcggaggccataggggtgtctcctttgtactggtgggctgatgtgccgacgaaaagaaagtcccaattatatgttgagcatataaactatgtttctcaggcaccctctgttcagtacagaggtatctttattaatgatgaaggttggggaataactccttgggccggaaggacgtttgataaagaattgggtgacatcggacctaaaacttatgctaaggtatgtgaactgattctcaggatgaaaggcaatatgctggcacctgcaatgcatccttcttcgggcgcttttaataagtatcccgagaataagttggtggcagatagttatggaattataatgagcacttcccattgcgaaccgttactttttaataacgtaacggagtgggataagaaaataatgggagaatggaattatatgactaacaaagaaggaataaataagatgctagaccaacgagtattggagaatgccccatatgagaatatttatacgattgctatgcgtggtattcatgatgccgggctcgtaggtgttcccaaagataaagaagtcaacctggtgcaggaggttattgctgaccaaagaggtattttgaagaaacatatagattctcctattgactctatacctcagatttttgttccctataaagaagtgcttgatatctacgaaagagggttgaggcttccagaagacatcatgctggtttggccggatgataatttcggatatatcaaacggttgaacaataaggaagaaagaagccgtagaggtggggcgggcgtatattatcatatttcatatttaggcgaaccgcatgactatttatggttgaatacaactcctccggcattgatgtttgaggaaatgcgtaaggcttatgatactggagcaaaacgctattggttattgaatgtaggagatatcaaaccgggtgagctgggtatgaaaacttttttggacatggcctgggatattgataagttcgattttgataacataaacaatcatcaggtggactttctggtttccatattcggtgaaaggtatagggaagacattgaagatgtaatgaatagctattatcatttgggcttccagcacaagccggaggcaatgggatggggatatgaatggaataatgaacatgttcaggagaggatgacggatactgacttctcttttataaattataatgaggcagaaggcagaatacaagagtatgaccgtatttctgataaaagcgaaaagatatggaacgcgttgccagaatcccataaggctgctttttatgagttggttttctatccagtgaaaggagcggcacttatgaacaagaaaatgctggtcgcgcagcaaaacagatggtatgcgcgtcagggacgtacagcaaccaactatttggccgatagagtcaaatcctatcatgatagcatagattattataccgataaatacaattccctgcttaatggtaaatggaatcatatgatggctttggcacccggatggactgccacctatcagaagatgcctccgctgacgactatcgatgtacctcaaaaagcagaaatgcggatttttcttccggaacaggattcccctttgggaaagactacattgaatgtgcttccttgcgtaaatccttatacccggaaagaatcttttattgaattgtacaatgtaggaaagcaagtgttcacgtggaatgccaaaacttctgattcctggatcaaactcagcagacagaacggaactactcagttgcaagaacggattattgtatctgtagattgggtgaaagttccggtaggggaaaggataacgggtgaaatagaggttatatccggcggtcgtcaggaaaaggtctacttaccggttttcaatcctgcttatcctacagtgggcgagttgaaaggatggtatgtggaagataatggctgtgtatctatcaatccgggaaaataccatagaaaagtggagaatgaagatataaagataaaagtcataaagggattgggctatgagaaccagtgcatacaattaggagaggccgtagaaccagtccaaaatccacgccgttccggggaggctgccaaggtggaatatgatttttatacttttaatgctggttcggtaacggtttatacgtatgcattacctgtctttccggtgaattcggaacgtggcacttgctttggtataatgatagataatggcttgttgaaatatgcttcgaataatgcaaaagaatattcaggtgaatggagggagaatgtatatcgtaacagtacgataaacgctgtaaccctgaatattgataagccgggcaagcatactttgaaattgatatgttctgaccctggtatgattatccaaaaagttgtgatagatatggggggaatgaaacgttcttatcttggaccagaaactacaattgtacgatagttagttggatttctgaggataaaataaggattaagactggtcgtgtttgtgaatcacatgacgttaaataatatggatttgaaatgatataaaaaacagaaatagctcgttattgacaaaagtgatatcgatggcgagttttttctttacaacaatggttgaacggaatttagtggtgaaattgttaaaaacggtgtctagagtgtttttcgggcaatgcgttttccttttgcttatctacatctcttttggacgcttatcggtatggttttcaaactaaccgactatttcattaagtttctcttttcaacagtattttttatttatgataaatatagaaattgattttataatatcaaaaaagaattttattctacaaaaaacggtgcgtgctttagttaaagtaaatatcgcctgcacgcttttggaaagccttctgtagatatctgtagaaacgtttggtatactgttgcgaaatcattaaatttgcaattaaaacaacgagagatatggatgcagatacccgtttaaaaacagaagagaagattatagccatgttgaaaaccgtatatgatcccgagattccggtgaatatatacgatttaggcttgatatataagattgatttgcaagatgatggagaagtagtgttagatatgacattgactgcccccaattgtcctgctgctgattttattatggaggatgtacgtcagaaagtcgactctgtggaaggagttacttcatcggtcgtgaacttggtttttgaacccgaatgggataaagatatgatgagtgaagaagctaaattggaattgggtttcctctaataaattgaaagttgagaattaaaattggaaaataagaattgccaatatgtctaagttattggacaaggtgttgtttttttaattctctattctcggatttttaatttatgaggtatttaatttagtaagattatgaagaacgtatatttcctttccgatgcacatttaggttctcgtgccatagcacacgggcggacacaggagcgccgtttggtgaattttctggatagtataaaacataatgctgcagcagtgtacctgttgggagatatattcgacttttggtacgagttcaaactggtagtgccgaaaggctatactcgtttcttggggaagatttccgagttgaccgatttgggagtggaggtgcatttctttatcggtaatcatgacatctggtgtggtgattatttggaaaaagagtgcggggtaactattcatcgtcagccgttgacctgtgagatttatgggaaggagtttttcttggcgcatggggacggattgggagataaagatgccaagttcaaattgttgcgttccatgtttcatagtaccactttacaaacgctgttttctaccatacatccccgttggagcatagaacttggcttggaatgggccaagcatagccgtctgaagcgtgaaggcggtaaggaacccgagtatatgggagaggataaggaaccgttggtcttgtttactaaaaattaccttaaagaccatccggatatcaattattttatttatggtcatcgccacattatgctagacttgatgctgagccgtacttcacgtatgttgattcttggtgactggatacaagatttttcgtatgctgtatttgatggtgaaaatatgttccttgagcagtatgttgagggagaaagtcaatattcctaaaaaaggctactatgcatcacgcgtagcagccttctataatttatatatttaaccaaacaataaaattacttattcagaatagccaaagtatcgctggcaatcatcagctcttcatcagttgggataacagctactgtcactttggagtcatcggcagaaataatagcttcttctccacgaaccttgttcttttcaaggtcaatcttcacacccatgaattccaaaccttcacaaacttcagaacggcaattggcttgattttcacctacaccgccagtgaacaggatgatgtctacaccacctagagcggcagcgtatgcaccaatatatttcttgatgcggtagaaatacatcttttcagccaaaatagctttcggatttccggcagcaacagcggcttccagttcgcgcatatcgctggatacacctgaaacgcctaatacaccactcttcttgtttagtaagttggatacgccggttgcatttaatccttctttttccatgatgaaagtaacggcgcctgcatcgatgtcaccactacgagttcccattacaagaccttccaatggggtcagccccatactggtgtctatacatttaccatctttgatagctgaaatggaaccaccgttaccgatgtggcaagtgataattttctttcctttcggatcaacgccaaggaattcgcatacacgttgtgaaacatagcgatgagaagttccatggaagccataacggcgcacaccgtatttttcatacagttcgtatggaatggcatacatatatgcatagtcgggcattgtttgatggaatgccgtatcaaatacacctacttggggaacgttgggcagaatggcagaaacagcattcacacctttcaggttagccgggttatgaagcggggctaaatcgttgcaagcgataaaagcatccagtacttctttattcagcaatacggattcgctgaaacgttctccgccatgtaccatacggtgacctactgcgttgatttcatccaatgacttgattgcgccatattccgggctcaccaatgtattcagaatgaactcgatacctgcggtatgttctgggatgtctttttctaatattttcttttcaccgttgggcaaagtcagtttcaggaaagagcctaccaagccgattttttctataccgccctgtgccaggacttctttggtagtcatatcaaataatttatatttaatagaagaactaccgcaattgagcactaatattttcatgatgttgttgttttttggagaatgattatttgttttctttagcggcaattgcttgattggcagtaatggcaatcatcttataaacatcgtcgatagagcaaccgcgtgacaggtcattcaccggacgagcgataccttgcaggatcgggccgatagcggtagcgtgtcccagacgttctactaatttataagaaatattacctacttccagacaaggaacaaccagtacgtttgccttacctgcaatttctgatcccggggctttgcttgcaccgatgtgcggaaccaaagctgcatcagcttgcagttcaccgtcaatcttcaaatcgggagccatttccttagcgattgccaaagcttccaccactttatctaccacttcatgtttggcagaacccttggttgaaaaacttaacatagctacgcgaggatcaattccggcaacagccttggcggtctgagcggtacaaactgcaatttgagccagttggttggcatccggtaccggggttacagcaacgtcacccattacgattacaccgttatttccgtattcgggagcatgagtcagcaacagcatggcaccggatacgcaagtgatacccggagtagtcttgataatctgtaaagcgggacgaagtacgttacctgttgtgttgcgtgcgccggccaactgtccgtcggcatcaccagccttgataatgagacatcctagatacagcggatcgacaaccagtttgcgggcctcttcgatggtcataccttttttcttgcggagttcgcacagcaattgtgcatactcttcttttttcgggtggtctgtgggatcgataatagtggctttaccgatgttccctaacccccattgtttagccaggctcatgatttcatcggggtttcccaataaaataaggtcggcaacaccgtctgtcaatatttggttggcagcttttaaagtacgttcttcagttccttccggaagaacaatgcgctgtttgtttgctttcgcgcgctcaacgatttgagaaattaaatccatgataatatattaattatgtacgttctaaagacgagtgttgtttttcacgatgcaaaattagctaattttgcaatatctacattgcaaaatcaatattatttttggtttaaagtatgctaaaagtgtatgttattgaacaccaaacgggatgtttccttaactttgcgcagttttcaataagtatttaataaatttataaggtatgattcgtcagtgcgccattttatttggctgtttggctttgggtgaattgattgtttttttgacgggtatcaagctgccgtccagtattataggaatgctgttactcaccctttttctcaaattgggttggataaaactgcaatgggtgcaggggctgtccgatttcttggttgctaatctgggctttttcttcgttccgcccggtgtggcactgatgctttattttgatgtcattgaagcacagttttggccgatagtaattgcgacagtggtcagtacggttttggtactggtcgtaacaggatgggttcaccaattagttagaaaatcaaatggaatatttagaaaataagttctttttgctggcattcaccttcggggtgttttttttgtcacgtgtcttgcagaaaaagactggatgggtggtgttaaacccgatcctgcttaccattgccgtgttgattctgtttttgaaatttaccggtatcagttatgaaacatataatgaaggaggtcacctgattgaattttggttgaaaccagcggtggtagcgttgggcgtgccactttatttgcagttggagatgataaagaaacagttgcttcctattgtcatttcacagttggcaggttgtttggtgggattggtggccgtggtggtcattgccaaattgctgggagccactccggagattatttgttcattggctcctaaatctgtgactactcctatcgctatggaggtttcgaaagccacgggaggaattccgtctttgacggccgctgttgtggtggtagtcggtctgttcggggcggtgttcggcttcaaggtacttcgggtaggtcatgtggggagtcctattgcgcaaggtctttctatgggtacggctactcatgcggtaggtacttctacagcaatggaaatcagtgggaaatatggagcatacgctagtctgggattgactttgaacggaattatgacagcgattttcacaccgacaattcttagattattaggtgtgatttaacaaaaaagctgttatctttgttatatatagaaaatcatcacagattatagaggattgatttgattttcaataggtatggtcattggggtgagcattgcttataaaaagtctatccgcatttagtagtaacagagcattcttacagcagtctgataactattgtcactttgaatgaaatgaagattctgtgatttgtggtgagaaaacaagcaacccatattttatgatagaatttaaagatataactttagcggataaagacttgatacagtcctttaccttaggcagtttgcgtcgtaattgcgacttgtcgtttgccaatctgtgtagttggattttcctgtaccagactaaatatgccgtgatggataattacctgttgctgcgtttctatgcgggagaagaattggcctacatgatgcccgtcggaactggagatgtgaaaccagttcttgaagcattgataaaggatgctgaagagatgggggcaaaattgcgtatgctgggggtatgcgtggggatgaaagcggacatagaggcggcgatgcccggacgtttcacttttacagaagaccgggattactttgattatatctacttgcgtactgacctggcaaccttgaaaggaaagaagtttcaagccaaacgtaatcatatcaacaagttcaagaagcagtatcctgattatgaatacaaaccgttgactccagatctggttcccgaatgtttgaagctggaagaggaatggtgtcgtgccaataactgcgaggaacaattggcattgggggcagaacgtaagtccatgacatatgccttgaaccatatggaggcgttgggtttgacgggcggcgtgcttcatgtcaacgggaagattgccgcttttacatacggtgctcccatcaatcatgaaacatgggatacttgtgttgaaaaggcggatacgggaatagaagggtcgtatgccatgattaactatgaatatgcaaatcatatcgacgaacaatatatatatgtaaaccgcgaggaagaccttggtctggaaggtttgcgcaaagcaaaactttcttatcagcccgttattttactcgagaaatgtatagcagagctcaatgactacaaaggatgaagtgaaaacattatggaaactctgcttcaatgatagcgatgagtttaccgacttatatttcaagatgagatataaggatgaagtgaacagggtgattcgtgaagacggaaagattatttccgcattgcagatgataccttatcctatgactttttgtgatgaggtgatttctacttcgtatatatcgggtgcttgtacgcatccggattacaggaagcatggagccatgaaacgcctactgaaggaaacacatcggtgtatgtatgaagatggagttttgctggcttcgttgattcctgcagaggaatggttgttcggttattatgccaggtcgggatatgctccagtttttgggtatgcggttgagcaggtaagggtagacagattatgccctgcgcccggttgccggatagaagtatgcgaatttcccggtgtggaacattatcattattttgattcccgtatgcatggacgcaggagttgcattcagcatcctaaagaagattttctggttattatggccgatttaagactgggtaatggcaaattgctggttgcctgggaagcggataaaatagtggggatggcatttacggtaatgggggatgatacattatatataaaggaattgctggcagatacggatgcggtgcaggatactttattgtatgaagcggcccatatatataaggtacagcgtatggattatttcattccgtcgtctgccgatactttgtttttggggatggcaagagttatccgtgcagaggagttgttgaaggttttcgcccataagtatccggcatccgaactttatatacatattgagggagatgaagcgattcaggagaataacggctattatacggtacgggatggtttctgttttcgtgagagagtaccggaaaaaaaatatcacacttatacgttggatggttttacccggttgttactggaagcggagcatccttatatgagtttgatgctgaattgatctttattactggttgcctaggttgaatttctatgtttaagattgataatcagtggagtaaaaatccggataggttattagtcttcttttgtcagaatacgttccagctcttcggcagtcagtctgagatggaattgtcctttataagccacggatatgccacctgtttcttctgaaacgataatggccaatgcatctgtttcctgcgatacgcccatggcagcccgatgtcttaatcccaattctttagggatattcaagtcgtgagataccgggagaatacaaccggctgcttctatccgtttatggcggataatcatggctccgtcatgtaatggactgtttttgaagaaaatattttctatcagtcgttggttcacattggcgttgataatttctcctgtacggatgatgtcattcagaggtacacttttttcgatgacaatcagtgcccccaccttccctttgctcatgctcatacaggcaagtacaatcggcataatatccgctttttccgtcttttcctgcttgtttcccgtcaggaagcggaaaaaacgtcccaactgtttatgcgagcccagtgtgacaaggaaccggcgtatatcatcctgaaaaagaataatcagggctaggacacctacactgaccaatttatcgaagatagaccctagcagtttcatttccaaaacctgagatacaatcagccagatacctataaataccaggataccgatgaagatattgatagaacccgaatctttcatcagacggtaagtctgataaagcagataggctaccagcaggatatcgatgaggtcttttatactaaaatcaataaacatctttctagaattaaaaattgaaaattaagaattaaaaggcagcggagtctttcatcttctgtactatcttcacggtttctacagcagcttttacatcgtgcactctgagaatatccgctccttttagtagggaaatggtatccagcactgttgttccgttcaaggcatcatcaggggttccgcctagcagcttgtaaatcattgatttacgtgatatgccgaccagtaacggtagttcgaacaggctgaattcttccaaatgattcatcaactggtaattatgttccactgtttttccgaaaccgaaaccagggtccagaataatatcttttactcctaagtcgcgtaatttctgtactttttccgagaaatagagaaagacttctttcaacagattgtcataatgcggattcatttgcatattttgcggcgtgccttgcatatgcataataatataaggtactcccagcctggcaatcatgtcgaacatctgcgggtccatttctccggcggcaatgtcattgatgattgccactccgtactcctctacacacatccgggctacatccgcacggaaagtgtccacggacaccacacaaccgggatgatagcgattgatgatttccagtccggtacgcagacggcgcatctcttcctcggggctgatgtgctcggcattgggacgtgaggaataggcacctatatcaatgatggaagctccttcttctattatttgggaggtacggttgataatatctttttccgtttgctgccggctgccggcatagaaagaatcgggtgtaacattcaggattcccattacttgcggatgggagagatccatcagtttcccattaacattaatatatttgacggttttggtttccattgtttacggcttgtcatttaggtcgtacaaaagtacgcacaattcttgagtttttgttatttcatgaactatttttcagttatctttgttgcaacttaatttaaaagcaaagcgaaagatggatatttcagctttatataagtgttttacggaatgcggcaaggtaactaccgacagccgtaactgccccgagggttctatgttcatagctctgaaaggggaaacattcaatggaaatgcatatgcgcttcaggcgctggaaaaaggttgccagtatgccgtagtagatgaaaaagaatatgccgccgatgggcatccgcgtatcttgttagtagacgattgcttgaaagcattgcaggaactggctaattatcaccggcataaaatgggtacccgaatcatcggcatcacgggaaccaatgggaagactactaccaaggaattgatagcctcagtgctgcaaaaaagatatgaagtgctttatacacagggtaacttgaataaccatatcggtgttcctctgactttgctgaggctgactcccgagcatgaactggctgtcatcgagatgggagcgaaccatccgggtgaaatcaaggcactgacccgtattgtagaaccggattacggtatgatcactaatgtgggcaaggcgcatttggaaggcttcgggtcttttgaaggggtcatcaagactaaaggtgagttgtatgagcatctgcgttacaatggcaagcatattattttcatagacaaggacaatgagtatctcacagctatctctcagggccttacccgtatttgttatggtatggaaggaggagagggactttatatcagcggcaagctgggcgcttgtgctccgtttctttcgtttgagtgggaacacgagggacagaagttcgaggtgaatacccaccttatcggcagttataacatgaagaatgcattggccgccattacggtgggccggttcttcagtgtaccgtcccggcagatttgtgaggcactggaggcgtatgttcctcataataaccgttcgcaattgacggaaaccacggataataaactgatagttgatgcatacaatgcgaatcctaccagtatgatggcggctttggagaatttccggttgatgaatgtcgctcataaaatggttattctgggtgatatgaaagaactgggagaaaccagtcatgaggaacatcagaagattgcggattatctggatgaatgtaaatttgaccggatacttttggcaggagaggagtttggcaaagtgattccgtcctttgaacattttaaagatgtggttgcattgaaagagtcgttggaaagatataagccgaaaggatattatattctgattaaaggttccaacagtatgaagttgagccagcttcaggaaatattatagttaaccggttggcagtttcattcacagtaggaggatgaatgtgtcaaaagtccaaagtaactattaaatgtgctgtttgcacctgtataggtatattgtcccacctgggtggaactgccatttcacaaaggtggaactacgctctcaccagggtgaaatgcccatttcatccgggtgggatttctatatatgctgcatggaaacatgaatggcaaagatcctttggggaatgatccttcacatagtctgcctctatggtaaatgtaatcatagaatctttcttctttattatttctctgaatttttctttaaaatagatataataatcggttttgaccgttttctgactccttcctgccgaattattatcccgtgttattacagaaatcagttacttttgcaatgttatcaatagaattgctatgaggaacttatttctactaatcgcattatgctgtgtggctttttctgttcgtgcccaacgtctggttgaagtggggaaaggctttagcagtacttcggtaaatactactgtattccgtaataactccattgtgacgcatggaaacacacaatacatttcttattatgacgctgaaggatggctgatgttaggcaaacgccgtctgggcactggggaatggattttgcaccgtacccaatacaaaggacatgtaaaagatgcacataacattatcagtatgatggtggacggcgacggctatcttcatctttcttttgaccaccacggacataaactgaactattgccgcagcattgcccccgatacacttgttttgggagataaagagccgatgataggcaacgaagaagaagatgtgacctatcctgaatttcatttgttggctgatggcggtttgctttttgtatatcgctcgggcgcttccggaagaggaaatatggtaatgaaccgatatgatgtgaaatcccgtaagtgggagcgtgtgcaggatgtccttgtagatggagaaaacgagcggaatgcctattggcagttgtatgtggaccaatcaggaaccatccatctttcctgggtgtggcgtgaaacctggcatgtggaaaccaaccatgacttatgctacgcccgttcttttgacggaggtagaacctggtataagaccaacggacagaagtatgagcttcctatccgcctgggcaatgccgaatatgcctgccgtattcctcagaatgccgaactgataaaccagaccagtatgagtacagatgccggaggtcatccgtacatcgctacctactggcgcaatcccgatagtgatgttccccaataccgcatcgtttggcatgatggcgtgaactggcacaaccgacaggtttccgaacgcaagacccctttctcactcaaagggggaggaaccaagatgattcccatgtcccgtccccggatggtggtggacaatggagaagtgtactatctgttccgtgaccaggagcgtggaagcaaagtttccatgtactataccaaagacatacagtttggtgaatggcacgtgaaagacctgacggattttgccgtaaatgcgtgggaacccagtcatgacacggagttatggaaaatgaagaaacaacttcatatttatgtacaggatacccgacagggagatggcgagaagcaggtggaaacagaaccgcaaatggtttatgtgttggaattgtaaataatgtgctgatttgccaatgaccatgcggcatatagcgcaagcacattaacacattagtaaattggcaaattgataaattattaatatgatgaacaaattattgaaacaaacccttgtttgtgcaggtaccttgctgctttccatgcaggttgccgccaaaccttcttccgaagccaaggaagtacgggggattatagacaaggtaaacacttattggcaaacgcataacaagcccgaagtccgttcgttttgggacaatgccgcttaccacaccggaaacatggaggcatactttctgaccggtaatgaaaactaccgtgcatattctgaagcctgggctatacacaatgaatggaagggagccaaggaaaaggataagtctaaatggaaatactcttacggtgagagtgatgaatatgtattgttcggagattatcaggtttgttttcagacatatatcgacctttatactattcttccggacaactataagatagcccgtgcccgcgaagtgatggagtatgagatgagtacacccaatcatgattactggtggtggagcgacggtctgtatatggtaatgcctgtcatgaccaaactgtataaggtgacgggtaatcatctctatttggataaattgtatgaatatattgtatattcggacagtatcatgctcgaccgggaaaccggcctgtattatcgggatgccaaatatgtttatcctaaacacaagacttccagcggaaagaaggacttttgggcacgtggtgacggatgggtgcttgccggactggcgaaggtgctgaaagatcttcccgctgattacgagcatcgttcttttttcgtaaacaagtatgtgaaactggccgaagcagtcgcagccatccagcaaccggaaggctattggacccgtagcatgatggatcccactcatgctcccggaccggaaaccagcggaacggctttctttacttacggtttcctttggggaatcaataatggctatctggatgaggcagtgtataaaccggtgatagataaagcatggaactatttggcaaagactgctttgcagaagaatggtaagattggttacgtacagccgattggtgagaaggccattccgggacaagtagtcgatgctgattctgaagctaatttcggggtaggtgcttttctgttggctgcttgtgaatatgtccgttatctggaagctcctgaaaatcaggatcgcgcctactggtgcaatctgctttataagatggcagctcccgtactgagcaatatggcggaaggtaatctgaaaaagaatatgctggtagaggtgagccctaattgggatggacgtaacaaaggggtgacttatatggaaaccttcggacgccttatggcaggtgtcgctccctggttgacacttcccgatgatgatacggaagaaggacagatgcgtaagcaactccgtgaatgggcattgaaaagctatgccaatgcggtggaccctgccaatcccgactatctgttgtggagaggacacggacaggccttggtggatgcggcatacgtggccgaaagttttctgcgtgcttacgaccagctttggatgcctttggatgatacaaccaagaaacgttattttgaagaatttacccagttgcgccgtgtggacccgccttacaccaactggctgctgttttcttctaccatcgagagtttcctggcaaaggcaggagcggaatgtgacgaatatcgtatcaattcggctatccgcaaggtggaggaatggtacacgggagatggctggtatgcggacggcccttctttcgctttcgactattatagcagttatgtcttccatcccatgtatctggaaacgttgcagggcatgaaggatgcagggaaatacactcgtattcattataaaaaatattatgaccgcgccttgaaacgtgccaggaaattcagccttgtactggaacgcttgatttctcctgagggtactttcccggtattcggccgttccattccttaccgtttggccactatgcaacccttggcgctgatggcttggtatcagcagttgcccgaaggggtgagcaacggacaggcgcgtgccgcactgacttctgtgatgcaccggatgtatgacaacaccgagaacttcaatgaggcgggcttcctgaccatcggttttgcaggccgtcagcccaatgtggcggattggtacaccaataacggcagtctttatatgacatcattggcgttccttccgctggggcttcctgccgcacatccgttctggacagatgccgcacaaccttgcacacaagccaaggcatggggcggacagcctttcccgaaagaccatcactggagtgatgatatacgcacttgggatttattctgattgcttttaaatccgaacgccgcagatgatacgaagttgtttttatacttatccgtatcatctgcgttgttcgtgtttaaaaaataaaagctttgtgtcatctgtatctgaaaatggcaaaaagatagtagctttgcagaaagaagttacgaaaagagtgtaatttattggaaatgagcgtaggttaattgctcttgatagtaataggttacgatttagttagttatctactgcattatccttctgcgcgttgcgtaaccttcaaagaactcttcgtatgcaaaagtagctatttaattcgagattttgatataaactcccgttttttatcccctcattcataagaattttccgtaaaagcggtattgtccgtcggcacaccattgcccaaaacgagtttggaacaaacgtgtgccgactaccgcatagctggagaaaagggcattgcctcacgcctaaacgatgtttagacagatgaagcaatgcccctttcttttgcgcctatgccaagagatgcttttacgggttttcaaatgatttttcttttttcgctgtctcttttgccggaagcggaaagtgaatgcagagtgtgtcagcctgccccatgaatgaaacaggcgcccacacacagccggacaaaccgggaagaatgattgttgccacccggctgaacaagttccgtcggatcggaaacaatcatacttcctttgttgtggtttgcccttttcacgcttccggtgatgtctttttccttttggtgattcttttttttacggattttcccctgaagtttttttctacacaatctgcctctgttttcgtttacctccattttgcgcctttcagtaagccgcatcagtcagtcattttcgttctgggcgcaaaggtaattccgggattggacgggaaagcaaggtcaagcctcctgttttcggtaaaaatctccagccctgcgggtagtattttgaccgaaaaaccttgcattccctaatccctaccttttcaagcacccgaaacgaaaacgaccgatgcgacagaaagacgcataaaaaaaatgtcggataaacgagaggcagataagatagtttgaaactcaactccctcagctcttgaatccgcattaaaaacaaaaaaatcaaaaacagcgaagatatgacggcaacggcaaatttcagacaaatggcgcaacacatcgggttggcgatatgcggcttgatgatgcgcaccgccttcggggtgttcggcatcctttggggcatcatcagagagattgtaaacggagtgttccgagtggcgataggtgtaatcgtggctatcctttccaccattgccttctttggcttcatcctttggttattcaccctttaacccttaccgacatggcaaaaagaaacagcaagacggcagcgcagcagtgcagatattacgaggtggacaacatcttcgtgtatatggtggaaacgtacatcaacggcaattttgaaactttccgaagattgtaccacgaactgaacaaggacgcacggagggatttcatggacttccttctcagcgaggtagagccgacctattggagagagatactgaaacagataatctaaaaatgacagcgatatgaaaggaacagaccatttcaagagaacgatatatatgtacttggaacagcgtgcggaggaagatgcgctatttgcaaagaagtaccgcaaccctgccaagaacatggacgagtgcgtgacccacattctgaactatgtgcagaaaagcggttgcaacggtttcacggacggagagatattcgggcaagccatccactactatgaggaaaacgagatagaggtgggcaaaccgatggactgccaagtggttgtgaaccacgttgtgaaactcacggcagaggaaaaggcggaggcacgtcagaacgctgtccgcaaataccaagaggaggaactccgcaagttgcagaaccgccacagaccgtcagcgagaaaagaaaaccaaccccaaccctcattatttgatttaggcttatgaaaccgaagaccaagatacagaaagaggtggcaagactttccgccaaccttcgccccatatcagcgacacaaatagattgggcataccgccactgcgttgagcatatcggctaccgcaccaagaaagggaacatcacctgttccgactgcggtcacgagtggcacagcgacagcggactatgcgacacccttgaaggctgcacctgccccaaatgccatgccgaactcaaagtgcaggacacacgcagacgcatctacaaggaaacgcagaatttcagcgtgataaccacctgcaaagggtatcaggtaatccgcgtggcgcaggtcagatgcgagagcaggaaaggcgaaccgatgcgtttctactgccacgaggtcgtgcagcgttggatttcacccgacggcaaggttacggacatggcgttgctccgtggcttccttttctgctattgcgatgtgtgggcattaggcagcgatatggaggtaagaccgcacaacagcctatacgatgatgtggtggcaagaagctgtgcatatccaaagatgaggatattgccccaactcagacgtaacggcttcaagggcgatttccacggcatctcccccgtgcgtcttttcaaagccttgctttcagacccaagaattgaaacccttatgaaaggcggtgagattgaggtcatgaaacactttcttttcaatacccgtactgccgatgaatgttgggcatcatatctgattgccaagcgtcacaagtatcagatagacaacctctcaatgtggtgcgactatctgcgtatgctcaaaaaactcggtcaagacctccgtaacccgaagaacatctgtcccgaagatttcatggcggcacacgacaacgcaacccgaaaaattgaagccatacacgagaaggaaagagccgcagagcaacgccgttgggagattgaaaggcgtgagcgtgagcaacagcgacaactccaacgaaagaaagatgcggaggatttcatcgccaacaaatccaaattcttcggcttggtaatcacggacgaggaaataatcgtcaaggtgcttgaaagcatagacgagtattacaacgagggcaagacgcagggcatctgcgtgtttggcagtggatactacaagaaagccgacaccctcatactatcggcaaggattggcgatgagattattgaaaccgtagaggtggacttgcgaaccctcgaagtggtgcagtgccacggcaagcacaaccaggacaccgaatatcacgagcgcatcatagaccttgtgaacaagaacgccaaccttatccgtgagcggatgaaagcggcatagcataacccctaaaacaacattgatatggaagtaagaattgaaagtatgatttgtgtgtgggatgatgcaatccccacgatgttccttgaatttgtgaacctcctcactctcacaacgagtgagggggaattgagaaagagcgtaaaggagtttgccgagaagcacgaacttgacaagtttttcctttacggcttcggctcacaccatttctacctgcaccaacgctacacaagcaaccccgaaatggtgatgaagaacagagttctgtcagtacatttttaaccatctaaaaagcaacattatgacaacacgaatgaccatcaacggagtaagcacctgcgcggaagcaggtacggagaaatacgagcgtttccaatcgggtatcggaagacgcaggcggacacttgtgcagtacgactaccgccaccccatagacagagaattgttctcttgtgtcaaacccacgttggacgagtgccgagccgcacgggacaagtggctgaacgcaaagaagggaaaggaggacagactatgaacacgacctatcaaacgctgatagtcaagttcagcgaacctatcacggcattggacggtatctttgacgataccggagcgtggggaacggacaccctcaaggggtggatagatgattacgaaagcacacgtttcaccgccaccgacagccatacggcagtcatcacgagcgagtacaatatggaatgtgtgaaagagtggctacaacggcagacccccatttccgaaatgcgagaattttgaacgggatggcggtgtccgcaccgccaatacttaaaaccctaaaaacaaaagatatgatagccaagacgatattacagcagataggcggaaaacgcttcaccgccatgacaggtagccgtgatttcatagatatgggcaacggcttacggatgagccttgcaaggaacaaaacaagtgccaaccgccttgacatcatctatgacgaaggggcagacctctacaatatgcgcttctaccgcaggacgttcagcaaaaagacctttgagtgcaagacaaaggacattgccgtacacgagggtatctattttgatatgctggaggaaatgttcacgatggtgacgggactttacacacgcttttgagtggcggggcggcgagagccgccctactttctttcagtgagcatgatggcggacaaagaaagtagcaaagaaacctttgtccaatctgcgataactaaaaaatccgcaagtaaaacttgcggaggctatatattgggtcgttattttttggtggaggggaatgataatctcgaaccgttgaactacacatttctgcttcgtctccatttcccccaacgatttgatacgttcaatcatttttgttgttcctttctgaattttcctaaatactttcttcataatttcgctatactttttatggttaataactatgttttgtattgctctcacaacacttacaacttgaagtgttatttggaaaccgataggcaaaaatggctcaacgatgtcaattaacgagaaaatcctacgataatctatcaagtgatagagcaaaagacgtgccaagttaaatatggcacgtcttttgccagttttgtcagtccttttatgggatatacaacagcgcaaactccgcctttctccgtttgagcagcatggcgtggcgttttcctttgtagttgcagaaggctatatactcacggtagatgttcctgtcaccagcttccagcttcttgattaaggtgcttttggggattgttttgctgcctaacagcttcgccggtcccacattgtaagctaacgtgccaagcaaaatcgaatcaaccccgaatttacggaacatggcgacaaatttgcgcaggtctttccgcaaaagttcatccgcatcccgttttgtcatggttcgtgccgaatacttctcgtttggcaaaagtttgtgaccccaaccgacgtatgggtagtgtttttctgagtgccagccttcaaagtagcggcagcataaaaaagcacgttccataagcggcagtcggtagattgccgcctgcccgtccgttccctcttggcggctgatctgcgcggacacagaacagaccgtcagaagtgaacagagcattgtcatgaatacacgcatcatttcaacaaggggctgaagttgccgatgggaacgatggtaagatcgtcgtcctttacattcctgttgttgaagtcaaattccagttcgtaggagttgctaaagttatcctccaccaccacgatgaaattatgcgcctcatcacccgccgccgtgtagtacaggcggaatttttcgttctccagcaggtagcggtcgttaggcaggaaggtgatgccgttatccattttgagcgagccttccccctcgaactggaaatagcggatggtatagagcgtacccgaaaagtcgccctcctttttcagttcacagcggatttccactgtctgcccctttactaccttgttcggcacgggcatgacctccaccgtgaagggataggactgctggatgtccatgtcatcgtcacatgacacgagggtgaatgacatggcggctatcaggcataacgccactgccttgaatattgatgttctcttgtttctgttgttcagtatgttcattgttcttcgatttttagatggttgtttttctgttttttcgttgtcagttgcaggtactcgttcaagtccttgcaaccgtcatagagggaggaacggtcggtgacacgttccccgtatcgcatggtaagtgcggcaagcgtccgccgtccggcttcgtcacggtcgaggaagcagccgatgcgcccgtatccgtccagcaatcccgccgccttctccacgttggcgactgagttcagcacaagacagtcagcgttaccggttacaccaagcgtcacggcagagagaaagtccatgaagccctcgaacacgaggcactcgtcagccgggatgtcattcgcctttaccagtgatacagacttcggaggtatgcaacccttgaaatatcggcttctgacttcatagccacctgccatgttcggaaagccaacggcaaaataccgtttcccacgcacaccgtagttcaagcggcagcagtgacgggatgcgatggcgtaagggatgccccgttcctctaaatactccgtcagcagtgagcggagcagcggagcgacctccacatcctcaaaaacggattcggtcggcttcgagagatagacgggcttttcccatccggcaaccgtcatattggcggcttccgctatgaacttcgcttgcttcatgaagtcatcgctttgcagaaactccccggcaagcgtgaagatgtcgccgcccttgcccaaaccgaagtcgtaccagagctgtttcgccacgttcacacggaaagaggatgtgcgctcgcccctgtacggggcaagataccacagctcgttaccgctccttctgacaggctcatgccccagccgtgcgagaaaatccgcaagcggcatccttctgacagcatctatttccgtcctttccatgcccgtgtcagttgatgatgaacttgataccgaccccgaactgcgtgtggaacttccgtgtgtcgccaccccaaaggcaacgctcccgcaggttggcaagcagggcgatacggtctgccacgtaacactccacatcgagcgtcagcgcaccgccgtagatgaaggcgtcccggtcgtgcagcgtggagccgtcatgcagcaccttcttcccccaatttaccgcctcatatccggcgagagccgaagccccggcatagacgaaaacaatctttcgggcgtccgacagtatcttgaagtaatagccgccctccgccgtgaactgcgccacgggtatcttggtgtccttgtagggattgttcttcaacaggtattcgccaccgaacacccacttgttccccttcttcgtgtaggtggagagagccgccccgaagctgtacccgccgtccttgccgccgagattgaagccgtccgccatgtccgccctcacctcgatgccctgcatcttcggcagacaccgctgggcgtgcgcctgccctgtaaaaagggcaagcgacgcgatgattattgcgatgtactttctcatggtcagcgtacttgaagttcgttgatggtacccgcgcgtaccaaatcctcgttctcaatcacgaaggactggtgacggccgccgttcttctcgttcaattccaccacgaggcacttgtcatcggggatggtgaacttcgccatcgtgaagaccgtgcgctcgctctttttgcccggcacgagggtggcgtagttctgcgcgcggagcggcagaataatctgctcctgcacggcagtacgcttcgcaaccttcttgtccacgattttccaagtgatgtagtccacatcgaaaggcacgttgctctggttctttatctccgtgtggaaataaagcaagccgttgtgcgtgtagatgcctttcaacaggtattggatgccgaaacgcttgcagccgatatgcttcacctcgcgcttgttctgtttgtggatggacttcatgataaggcgcaccagcatcgggctttcgctgcccagctctttcagatagatttcctgcgcgttgttcgggcggttcaccgtgctgccgtcatggatgaagtcgcacatctccacgttgagcaacagcggttcggcggcgtacttcacgttgaaggtgtagaaactgccgtcctccgtgatgacggacatattcgtttcgttgggaaaattccttacggtagccttcacacggatgatgttctccgctccgtcggctttcccggcaatcaggtcgggcgagcctaaatcgacatagcgcacctccgccggaaaaatgacgtggacggtcttgtcgtaggtcacttccagaccgtgcggcggtatcatgcggtcgaaggtcagcttgcgtgacagcccgtgatataggtcgccgtccgcctccttctgcggatagacctccttcgtcaaggtcggttgttcacttccgttggtcgtttcaacggttacattctcctgcgcgttggcagttatgatgcccatagcgagggcaaacatgatgattacttttctcattacttttggattttagtggtaatttttattgttttcaatatttttcttggtaaagcatgaccctgtacccggctttcagatgcaccttgacggttcgcatctttttggcgatgtactggctcgtgccttgtatcagccccttgcccaagtcggaggcgagctgcgccccggcattggtggagatgttgatgctgcttcccagcgagccgcccatgttggcggcgacctcccggacggcgttcatctccatcgagttcgggatgaagatgccgggctgtccgtccgtgtcatagaccgcaagctccacggggataatcgtgccgtcgtattccagcgaggtaatctcgatgtcgagccgctcaccctgtatcttgcccgtgccgaccaccaccgcaccccggggtattgtcctgcctgccaccgccataggctccagcaggcgcagccttaccgtctgcccgtccgtcacgctctgcgccccatgcacgcacgccggtatggtgttcctgtccaatacctccgccgtgccgacagccgtgttgaaaccccggttgcgttcctgcgataaggcggcgacaaactccgcgttactcataggctgtgagagtgaagaaactacttgatgctccacctgtctgataggcattgccttgttcttcttccctttctgcacggtagttggctctgccctctgttccgccgatggctgtcctccgttctgaccgcccatgtactttgccgccagctcgtaggacttctccataagagccacctgctcgtccatagaggaagccttgcccctctcgctttccagttccgactccagcgatgcgatgcgctccaacaattcgtccatctccgcattgtcgtttttcggctggtcgtagaagtttccgagcgtggcgttcaggtcacggtaggcggctgcggaggactggatggtctgcggcgtggctggctttgccctttcttccttgccgcccggattggcgaggtcgaagtccactccgttctccgttcccgctatctcgcggtcgaacatgtcgcccagctgcccgatggcacggttgcggctctcctgacgctcttccatctccccatgctcgtaggctttcagcttgtcgccgataatctgccggttcgccttgtcagcgtcgggcatctcggtgttgtatccgtccgttcccggcggttgctccttgccggaggacggggcgaatatcagccacatcgccccgatgaacaccaacaccatagcgggcagcacgatcatcttctgccgtttcagccgttgcgcctctgtcagcggttcgcgctcctttttcggtttccccgtttcgggagcagctttgttctctttcgtcggttcattctttgtctgttccatataaataaggtgttaagtgattgcctgtttccgccggggtcggcagttccacccgtccggcgtgtcccgtttccatatgtgagccgtcgttcctgccgatgtcatagacggctctgccgaaggtgtaaagggcaagcaccgcgaaggcggcgaacatccccagcacgatgcggcggcgtgtttccggcggcaagccgtccagataccctttgagacttgccgccaagcgtttccgtttgtcgtggagtttccaatacatgccccacattgattttctgatacttttcatgtcctgttaccgtttgatagtctgtaaatccttgttctcaatgatggtgaaaccctcgatggtaaaaccgttcgggttgtcatccgaccgcgatgcgttcagcaggcggcaggtggtcacgaggctgcgctcggtgacgttgctctgccggatgattttctgtgtggcgtaggtcacggcacggtagggataggcgttgaagtcgcacaccacgctgtccaccttcagcacttggttgatgttcccggcgatgatgcggttgtagtaccccttctccgcgaagtccgaataatagtggtacacgctcttgtccgccagcagcaaggcacgtttcacgttgtgttcaatcgcgcttttttcaggtgatagcgtgaagaacatctcgtggaaacggcgcacatgttcccgtgcctccgccgggcggttctgcgacaaatcctgagacaaggcgagcatcaggctcttgccgttgtccagcacatagattttctcccgttgcttctctgcgaaacggtaggagttccacacgctccacaccgtcaccacggcgcacagcgagaggaagacgataccgaacaggcgtatctgcctgaacgacgattcgatgtttctaagtgatttgaattccatttatattttccaatttatgattgcacattgattatttcagcaatttgccgacacgtccgactgcgtttcctgcggctgcacccgccacgctgcccgccatgcttccggctcgtcccgccatctggttcacgttgcgaccgtaaccgcccatgcctccggcttggataatccagcccgcaacggtgggaatggtaaagtagccgatgatgccgatgcagaggaatacgatatacaccccgtcgctcgaatccagcgagaagttcgggtctgcctgcatccgctcgatgtcgttttgcagcatcagaacctgtatcttcgccagtatggtgctgaacatgtccgataccggtagccacagatagacctgtatatagcggcatatccactgcgtgagcgtgttttggaaaccgtcccataccgacagggcgaaggctatcggaccgagaatcgccagcaccacgagaaagaaggtgcggacggtgtctatcacgagggcggcggcttggaacagcagttcgagtatctcgcggaagaagtcgcggatgctcttcttcatgttgtacattccccggtcgatatacattcccgccatcgtcaccatgtcggagggcgaccagccgagttcctccagttgcttgtcaaattcctcgttggacacgaggtaggcggtttcggggttgcgtaccatcgcctcgtattccagtttgtccttctgctcccggtatcggttcatgtccagcgtttccgcctccagcatctttgccgtgccctgtacgacgggtgagaggatgctgtttatcgtgcccagcaccacagtcgggaagaacatgatgcacagaccgatggcaaaaggacggagcatcgggaatacgtctatcggttcagctctcgccagcgactgccatacccggtaggcgacgtagaacagcgcacccagcccggcgatgcctttcgccacaccagccatgtccccacacagcggcatcatctgctcataaagtgaacgtaaaatctgatgaaggttgtcgaacttcataggctaccagtatctttcgttcatgttcccgtacagccccatgatgcggtcgaggtcgttcttctttttcgcacgcaggtaactcacggagatgttcttgttcgtgtagtagctcacgaggttgcggtaacgcttcatcttcgagtggcagcgttccaccacgtccatgcgctccttgtcggtcatggagagcgtggtgatgttcaccacgttcctgagttccgtcaacacttcgttgctttcctccagcagtttcgtgtagccgaaagcgattgcggaaagctcttcgggtctgaaattcccgtcacggagcatccgttggaaactgttcacatagatgtctgtgatgtcgcccaccatcaggatggtctgctgcaccttgcgggcgtccttgaccagattgttcaccgatttgagggcatcgtaatacttcttgccctgctgatagattttcaccgtctcctgaaagttgctcaccatgttcgtggcggtcttggaggtatggatgatgtttttggaggcattgatgatgccctgcgctagattgcccggatcgcttacgacccactgtgcgcttgccctgcccgcgaaaagcaggcacaggcagataatcattgttattcttgttctcatgttactttggattttagtggttgttattcttcggtcggatgtcccggctgcggcttcacccgcacatagtccccgtttggcgagaaagtcagcacatccgtggcctcgttgtaggacacgtcgatgcggaagccggtgttcatgaacaggttgccgttctcctcctgcaagagataggtttccggcttgagcttgcggcgcagaccgctacgacggaacaccgtcactttgtaggcttcgccctccttgtagataagcacgtcaggttttccctccacgctctcccagttcccgcacagcatgtcgcggcggttgtcggccacgtcgcaggattgcagcatcatgaccgccaatccgataaggcacttgctgacttgcagcattttcacttttggtaaattcatacgcgtttttcttttttggttgatacattctgttttttagttattccttgtttctccgcctttcggcaagctgccggatggcggcttcgatgtcgtcgcccagcttctccgccagacggtaaacctccactttttccgtttcctcggtggtgtacgccagatactcttccgcgctgacctccgtggcatagaccgccgactgcgtgccgcccaagcctatccacacctccttgtagagccgtgaagggttgttcgccatgttgatggagagtatctgcgacttctccttttccgtcagtccgagcaacgcctgtatctggtcgaacttgttcatatatttcctttggtcaagcaggattttacaatccgagttgttgataatgctctctttgaccaccggagaactgataatgtcgtccacctcctgcgtcaccacgattgcctcgccgtaatattttctgaccgtcttatacatatagcgcagatattcagccatgttcgccgatgagagggccttccaagcctcttccacgataagctgtttccgcacgcctttcagccgccgcatcttgttgatgaaggcttccatgatgatgatggtcacgacggggaacagttcgcggttttctttaatcgaatctatctcgaagacgatgaaccgcttgccgagcaggtcgatgttctccgtggagttgagcaggaaatcgtaacgcccgccccggtaatactgccgcatggtggtgagcatgttgtcgatgttgaagtcggacttctccaccttgatgtcacgctgtgccagttccttgcggtagtcgtcacgcatatactcgtagaaggtgttgaacgacggcacgatgctacggtcggattggatgcgctcaatataggcactcacggcactgcccagctcgccgctctccgtctttgtcaccttgtcgtcctccgacttccagagcgtcagcaacagggtcttgatgctgtccttcttctccacgtcgaagatgtaatcgtcggtgtagaacgggttgaagctgatgggcttatcttccgtgtaggtgaaatacacaccgtccgctccgcctgtcttgcgtcggatcatgccgcacaagccctgataggagtttcccgtgtccaccaataccacatgtgcgccttgctcataatattggcgcacgaggtggttcatgaagaaagacttgccgctgcccgaaggacccagcacgaacttgttgcggttggtcgtgatacctcgcttcatgggcaggtcggagatgtcaaggtgcagcggttttcccgtgagcctgtccaccatcttgatgccgaagggcgagagcgagctgcggtagttggtttcctctgtgaacaggcacaccgcctgttcgatgaaggtgtggaaactctcttccgccgggaagtccgccgcattgccgggtatcgccgcccagtagagtgtcgggcagtcgatggtgttgtggcgcggcacgcattccatgcttgccaactggctgcccacgtcgttcttgatatgcttcagttcctccgcatcgtcgctccacgccatgacgttgaagtgtgcccgtaccgaggtcagtccgtaggaatgggcttcgttcaggtattggtctatccactcgcggttgatgctgttgctccttgaatagcgagatagcgactgcatgttacgggcggacttctcgaacttctgcaaggtttcctcactgttgtctatcagcacatactggttgtagatatggttgcaggagagcagaagccccaccggggaggcgaatgacagtcggcagtcactccggtcggtggagagcttctcgtaacgggtgtcggtagccaccttgcccggcaggtcttccgcgtcggagagggtgtgcagacacaggcggttgtcgccgatgcgcatctcccttgccgaaagctcgatgtcctgcaaggtggtgtcaccttccggcatgagcgagaagtagcgttcaataagtcccgtctttccctcagtacccacaatctcatcggtggagaggcggcgcagcctgacaagcccgctgtcgttcatgatgcgctcgaactgttcgcaggcttccaagaacttggtcgtggtttccctgtccagctccttcgggatgatatgtccccggcacagcgtgctgaaattgctctgcatccggttacgctcctttgttgtcttggtcaggtagaggtagcaggtgtgtttcaggtacggacgctcgttgaagtgacgctcgaaagagcggcttaaaaagctcatgtcgtccttctgaagctccggtttgtagcgttccttgatgaaccagtcctgtttgtggacgacggagtagtccggcagcaccttgatagccttgcaccagcaactgtgtatcgcctcgtactccgcacccgtcacggtgtaaagttccggtagttccacctcgaaagccaccgtgatgtcggcgtcctttgagatgatgcagccatgctccaccgctaaaagtgggaacctgttttccagtgttgtcattttcgatgtattcctcattgtctttcttcctttcgttgtcgtttgaacagacgggttatccgccgccggttgataaggtatcggggatggctccgtgccgctcctaatttcatcagcccgtgttcaccgtaccgggcgttcagcgcgaaggtctgccatacaaggagggaggacgatgccgcgccgaagccgatacatatccactggtcgataccgaccatgtagaggatgacgaacaggacgaagagagccagcagacctccgcagaagatgaagaggtactgtgccttcaagcccttgaactctaccggacggccgatacccttgttgattgggtattcagccatacattatttattaaaggaagaatgagcgcaggatggtggcggcaacaatcaggaagatgcacgcgccgaaccacgaggcggctgtcttgctggtgtcggggtcgcccgatgaaaacttgccgtacacttttacgcccccgataagcccgacgactgcaccgatggcgtatatcagtttagttccggggtcgaaataagaactcaccatagaggtggcttcgttgatgcccgcgatgccgtttccctgcgcgaaagcggaggcggttgcggcgatgacaagtgccgcggagaggattgcttttctgtttttcaagatgttcttgttcataaactgttcttgttttttgccgtcaaaagggtggatggtcctttgtcgggcggttgatactttgtttctttactttggttttagtggatgcccgtttgtttccacggacgtgggcgtgtccgttgcggatggggatgcgccttgcgtttcctcgccgcgtgggttgatgtcattctttcatgttcatttcttttattgttgtcatacatagttgcgaatgtcgaactcctcgatgttgtccggcacgacgaactccttttcagatttcttcagccgaatctcgataagccccttgatgcggatgcctatctccgaagagccttccatcattttctcgtacaactccgtgccctccatgtcggtgaacaccttagccgccttttcacgttccgcctgtgtcgcgtccgggtttttggcggtcttgcaggcgtcgtcaatctcgtcaaagctgctgcccgaagcccgtggcgtgtccgaggcgtcctcttccggttcgtcgtccccgtatcccagttcctccggcggtatgctcgtgaaggtctcatcgagtttttcctccgggacttgtgccgggcgggatgcgtttcccgtttttccgtcgtcaaaagtagcctcttcctccgacagctcaatgcctttttcaatagtggcggcttcttgcgtcggtatggcagcggttgtccgggtggatgccatcctgaaacggctcttgccgatgatgtccgccttttccgcagggacttcctcgtgtgccgctatgcgtttagcctcattcccgtccagtgaccgccataatccgacaatgcccttgaagaagcggacaatccgcgtgtccatgatgcgctcgtaaaggagcaggaacaggaaccagaggttgcagccgaccgataccgccagcagaatgtctgtcatgctgattgtgtaattcatatccttccgtttttggttagaatactgaattgtaatttcgggcataaaggctctttatcgcatcttcgcactggttgaagtggtgcgtcagcacatggtcgatgtaagcggacagcgtaagccggtcatgcccgattacacgggtgatacgcatgatacgctcgtggtactccgggcgcacatacgccatcttcccctcacgtgcctttacttccgggtcgcggatgaacaggcgttcatagtccttctcactgcatttgccgcttaccgggacaggcgacagtatttccacactcgcctgcacttgggtaaacatacctccgcagtcttgctgtggtcttttttcattcggtgtcatttctttttccattttcaaatcagatcttcacgttgtttcttgtacagttcgttgattctctccttgtgctgttccagatgctggcgcagcacggtatccacatatccgcctactgagatttcccctccggcgatgtcgttcacgattctgaggatcttgccgtggacgtcacggctgatatagacacattggcgggtctttatctcgttgcggcgcaggaatagctcgttgtagtcctcgtcctgccttttccggcgtccactttccctctgcgctttttcccgtgttacgggttgcacaggagatggttccggtgcggcggtgtcctcttcggtcggtgcagctgcgggtacttcctgtgcggggcgcagtgtcccgtcctgtgtgcgccgcccgatggaggctaacagcagttcctcgtcgatgccttccgtgttcactttcctgctgcccatgctcactgcggtctgatgatgtcgcttatctcttcggaaaactcccggatgccactccctttcagcagtgccgtgtccatcgggaagatggtggagcggaaaacgctcttgcgctcttccgaaaggtcacggcggaacttcttgctgtcgggcaagcgggtggaaagtaccggaaagcccatttcggctatcacttcctcgtagatgccgtacaagtcgttcctctccctgccgtccaccatcgtccagaacagatgcagcccctttgttttcgcctgtccggtagtcatcagcctgtcgcggaacatcgtgacgaatttcagggtactctccacgacaaagcggtcggcactcagcggagtgaaaatgtagtccatctgcgagagcgtctttatcacgccgttgcttcggagtgtgccgggcatgtcgaagaacaccacgtcgggtttcacgtcctcagtggcaatcatcctctcggcatcgtcgagggcgttcaccgcattgcttttgacgatggtgtaggcgttctttttgatccggcggaaatggtcgcaagcgagagccttgaagtaggtgctgctgtcgataagccccatttcgtgttcgcgcagcccgtggatgctgtgctgcgggtcgtcgcagtccacgacggcgacattgtagcctttcacgttgtgcaggtagctggcggcaagtgccgtgacagtggatttgccgatgccacctttctgtgttgcgaatgcaacgaagatttccttactcatagttccatttattttaattgttgatgatttgtttttctgtttccatacggatttggctgtcgcaccatccgcttccgtgactacacacgcaggcgggtcgtcgcgtatccggttctgtggtgaagcggtgcgtcggacaaatggtgattgacgacattgcgtcatgaagtcattgaatccatacgtcaccgaattgtcggagaaccgggtttccgacggttcgggtatccgtttcggcaagtatccgaagaagcggatttccgggtatttgaatgttccgtttatcatatcttcaaatcgttcgtttcttgaatcatgctgcaaataaacaagtatattttggaacctgtatcacttctccggcaagtggcggcacgttgcgccggttggcagtcattgaccgggtcaagcatctgtccgataccgctttaagggcgtaactttgcacccggacagcagggttcgccgatgacgcgcggcccggagtcctgaaaggtattttcccaatccgtcccctgacggatttttatgttcacctgaacatagcaagatgtcttttcagccgctcaaaatattttgagcagccacgaaaagcacttgcccttgcagggggcgggctttccctccgaagtcgggaagcctttcagaactgcggtgctgtaatccgaagcggcggcttatgccgtcaatccgctaaatccaaagtaatatgaaagagaaaaggaaaagcaaatcagggagaaatcccaaacttgatccggcggtgtaccggtacaccgtccgtttcaacgaggaggaacacaaccgtttcctcgccatgttcggaaaatcgggtgtctatgcacggtctgttttcctcaaagcgcacttcttcgggcaaccgttcaaggtgctgaaggtggacaagacgttggtggactattacaccaaactgtcggattttcatgcacaattccgtgccgtgggtacgaattacaaccaagtcgtgaaggaactgaggctgcatttttcagagaaaaaggcgatggcgttgctctacaaattagagcaacacaccgtcgaactcgtgaaactgagccgccggattgtggaactttcaagggaaatggaggcaaaatggtcgcaaaaatcagtgtaggaagttcgttgtacggcgcgattgcctacaacggggagaagattaacgaggcgcaggggcggcttctcaccaccaaccgcatctacaatgacggttcgggaacggtggacataggcaaggcgatggagggttttctcaccttcctgccaccgcagatgaagatcgagaagccggtggtgcatatctctctcaacccgcacccggaggatgtgctgaccgatattgagttgcagaatatcgcccgcgagtatctggaaaaactcggtttcggaaaccagccttatcttgtattcaagcacgaggacatcgaccgccaccacctgcacatcgtgacggtcaacgtggacgagaacgggaaaaggctcaaccgggattttctctaccgccgcagcgaccgtatccgcagggaactggaacagaagtacggattgcatccggcagaacgtaaaaatcagagattggataatccgttgcgcaaggtggccgcatcggcaggtgatgtgaagaagcaggtaggcaacaccgtgaaggctctgaatgggcagtaccgtttccagacgatgggcgaataccgtgcgctcctttccttatataatatgacggtggaggaagcgaggggcaacgtgcgcggacgggagtatcacgggctggtctattccgtcacggacgacaagggtaacaaggtgggcaacccgttcaaatcctcgcttttcgggaagtccgcaggctatgaagccgtacagaagaagtttgtccgttccaaatcggaaatcaaggataggaaactggcagacatgacgaaacgcaccgtcctttccgtgctgcaaggcacttatgacaaggacaaatttgtatcccaactcaaagagaagggcatcgacaccgtactgcgctacacagaggaagggcgcatctatggggctaccttcatcgaccaccgcacgggatgcgtgctgaacggttcgcgcatgggtaaggagctttcggcgaatgccttgcaggaacacttcaccctgccatacgccggacaaccgccgataccgctatccatccctgtggatgctgcggacaaggcacacgggcagaccgcctacgacagtgaagatatatcgggcggtatgggcttgctcactcccgaaggtccggcggtagatgccgaggaagaggctttcatccgggcgatgaagcgcaaaaagaagaaaaaacgcaagggcttgggtatgtaatcagagtatcaacaattaaaaaatcaatgtatgtcacaacaagaagacgatttgagggcattggcgaaaatcatggattttctgcgtgccgtgagtatcattttagtggtcatgaacgtgtactggttctgctacgaagccatccggctgtggggcgtgaacatcggcgtggtggacaaaatccttctgaacttcgaccgcacggcggggctgttccattccattctctacacgaagctgttttccgtccttttgcttgccttgtcctgtctgggtacgaagggtgtcaagggtgagaaaatcacttgggggagaatctggacagcatttgccgtcgggttcgtgctgtttttcctgaactggtggttgctgcccctgccgctgccgcttgaagcggtgacgggactgtatgtccttaccattggaacgggctatgtctgcctgttgatgggtggtctgtggatgagccgcctgttgaaacacaatttgatggaggatgttttcaacaacgagaacgagagtttcatgcaggaaacgaggcttatcgaaagcgagtattcggtcaatctgccgacacgtttctattacaggaaacgctggaacaacggttggatcaatgtagttaatcccttccgtgcgtccatcgtgttgggtacgccgggcagcggcaagtcctatgccgtggtaaacaattttatcaaggtgcgacacgaagttgcgtaaataattgttcaaaattctaatccacgagctggaaccctatcatcttcatatgccatcttattttttagagacatttactgaatatccctattttaactccgccaaatccaaaggattaaagcccggtacatcctcgccagtgagcggataagagaaaatatatgttttttcttccccgtccacaggattaaccaatacctttattcctttcaattcactgttttccggtgaataatcatctaatttaaaagaaaccataccaggtaccaatctgccctgacttccgttgttattatagcggagttccaaatgcgcatatccgtcctttgtccaaggaatcatctcattcacaaccagattaagaataggtttctgcggactgggaaaattcaacataaaacgtacattcagatagtcatcagaaggccacatatccttgatctgtactttcatatttccaatactgtccatattatcggggttcaatccgataatttcctgaacaggtactaaggtatagtcattcaaacggatattataagcaaatccactttcaccggcttccaaaaaagaataatttccaaaaatccgttctcctgccttcaaatcccggtaaggaacaatatgctgcaccacccacaacttctctccgttgtccaacaccaaataaggagcatcatactgaggttgtttttctacggtagccatagctatagtcaccgtactgtccggatcactttcatcattaccacaagatgaaaaggagaatactccgctcaaaagaagcatcgcccctaacatagattgaaaaaaatatttcatatacttccagggtttaagttgtttacccgaaagaacaaaaagagatcgtgaaaagtttatttcttcaacaaagctaccatttcacgggctgctgtccccgaagctcctgccggacctaaaatctgaataatacgatcatactcttccaacaccttatttctgtataccttattatataaaagagattctaactctgaacgcacgttatccaccgtcatcgtatccgccaccagttcacgaaccacttccttgtcggctaccagattaaccaacgaaatatatttcacttttagaatatgccggcgaagaaaagcgataaatttccctaccggagtatagtaacacaccacttgaggaacacggaaaagagctgtttccaaagttgcagtacccgaagtcaccaatgccgcctgcgcgtgctgcaacaacctgtaggtctgtccgaaaatgattttaaccggtacattcggatttatataatccgaataataggcagggtccatccccggagcccctgccagcaccaattgataatctttggtaaacggagcagcagcctccagcatcatcggcaggttgtctttgatttcctgtttccggctgcccgccaacaatgcgataacaggcttttcggacaagccattatccgccacaaattccggaaatccatccggatgttccttacaataagcatccactgcatctacacaaggattacccacataatgaacagggtactgatgtccggcaaaaaactcaatctcaaaaggcaggatggaaaacagttcgtctacatcccgcttgatatttttaatcctatactctttccaagcccatattttaggagaaatataatagtagacaggtattttcgtctgcttctttataaactcggctattttcaggttaaagccgggataatccaccagaatcactacatcaggagcccaacgaacaatgtcctgcttacattctttcatattccgaaagatagtacgcaaatgcaacaacaccgggataaaacccatataagccagttctttgtaatgtttcacccgcgttccaccaacagccgtcatcaagtccccgccaaagaaacggaattctgcttccggatcttcctgtatcaaggcacgcatcaaattagatgcgtgcaaatcgcctgatgcctcgcctactatcaaatagtatttcatacttccagattccagtttttcaactcattcatcatcccataagcagtcacatcaatttgggtcggagttaccgccacatacccatgccctaatgcccagtgatccgaatcttccgcttccggttcatagttatcaaactctccggtcagccagaaatactctcccccccgaggatgcagactacgcttccattcattaatccaagccccattcgtctgacggcagatgcgtacccctttcaaggaagctgtatccggaaagttcacattcaagcaaatccccaaaggcaagccatgctccaggacctgctcagtaatacggcgtatataaggcagcgatgaagagaaatcagcatccgcaaaatgattacataatgaatatccgatagaagagatccccttcagacacccttcaatcactacccccatcgtaccggaataatgcacattcactgaagaattatcaccgtggtttattccacctatcaccacatcgggacgacggggaaccaccgtatgcaatgccagtttcacacaatctaccggtgtgcccgtacatttatacacagtcaaatcctcctcttcacgtaccttgtaatacttcacaggatgctcggaagtgatcgcccccgaagctcccgaacgaggaccgtccggtgccattacgattatctcacccattccacgcaacccgcgtatcaattcattcaatcccttagcttccacaccgtcatcatttgacagcaatatcaacggtttttctttcttcatatttttccactctttttctcggagcgtaaagatacaactctttgccggaactacccctcaccggaaaagaaaattatcttaatgttctacaacccagtgctaaaaatagaatagaattgaatgaaaatttctatctttgccgccgttgagttattaacaaaaccaatgagttatcaacagttttgctaatgtctgccgttttttataggtgcaatcacctattatttgttacttcgcagcgagaaaaactgattaatatgggaaaaattattgctttagccaatcaaaaaggtggcgtaggtaaaactaccacaacgattaacctcgcagcttctctggcaacactggagaaaaaggtgctggttattgatgcagaccctcaggccaacgcatcatcaggattgggtgtgaacatcaaagaggtagaatgctctatctatgaatgtattatcaacgaagccgatatacgggaagcaatttataccaccgacattgacggactcgacattgtttcttcacacatcgacctggttggcgcagaaatagaaatgctgaacctggaagaccgcgagaagatcatgaaaaaagtattagcccccatgcgggacgaatatgactatatcctgatagactgctccccgtcgttaggcttgataacaatcaatgcgctgacagcagccgattcagtgattatccctgttcaatgcgaatattttgcattagagggcatcagcaaattgctgaataccattaagattattaaatcgaaactgaatccttcactggaaatagaaggcttcctgctgacaatgttcgattcacgtctgcgtctggccaaccagatttatgatgaagtgaaacgccattttcaagaattggtattcaagacaattatacagcgtaacgtcaaactgagcgaagctcccagccacggcattcctgcaatattgtatgatgccgactctaccggagccaagaatcatttggcattggcacaagaaattataacacgtaacagtaagtaaacaatggcagtacagaagaaatttgctttaggacgcgggcttgacgcactgatctcgactgaagaagtaaagacagccggctcatcttctatcaacgagatagaactgagcaaaatatccgtcaaccctaaccagccgcgtcgtgaatttgatccggtggcgttacaggagttggccgactctattgccgaaattggtatcatccaacccattacgttgcgtcaactgagtgaagactcttaccagatcatagccggagaacgtcgttaccgcgcctccatacaggcaggacttaaatctattccggcatacatccgcacagccgatgacgagaatgtaatggaaatggcgttgattgaaaatattcagcgtgaagatttgaattcattggagattgcactggcttatcaacatttattggaacaatatgcattgacacaggaacggctgagcgaacgtgtagggaaaaaacgtaccactatcgccaattatctgcgcctgctgaaacttccggcccagattcaagtagcattgaaaaaccgcgaaatagacatgggacacgcccgtgccttattgtccttagatgatcctaagacccaaatacgtatctttaatgaaatacagtcacaaggctattctgtccgtaaagtggaagaaattgtcaaggcactgagcagtggcgagacagtggacagcggtgggaagaagatcaaaccgaaaggctccaaactatccgaggaatacactttgctgcaaagccacctctgcggattcttcggttcgaaagtacagctatcatgtacagccaaaggaaaaggcaagatcagtattccgttcaataacgaagaggacttggaacgaatcatggaaatactggattcactgaaaaagaaagaataaagcgttattactacattgaaaagaagaacatccacatataaactgtttacattcctgcttttatgccttatgatggctggaagcatgaatgttcacgcccaaaaggcacgcaaccgccgtatgggtataaagacagattctattatacaagtcaaagattcacttgtcattgacagcctgaaactgctggaagaacggcaaaagatagaaaatatggaagcacctgttgatactgccgctttagtccgtaaaaatgattccatacagaaagcaatggctgccgaaacaaaaccccggtttatcccgaactccaaccgtgccatctggctggcgttggtaattcccggcggaggacagatatacaaccgtaaatattggaaactgccgatagtatatggtgggtttgtgggatgtgcatatgcgctgacctggaacaacagaatgtacaaggactattctcaagcctatctggatattatggacgatgaccctgataccaaaagctacgaagacttcctgcctcatggcatgagcgcggaaggtatggaggacacctttaaaaaacgaaaagatttctatcgccgaaatcgggatttaagcatattctgttttatcggtgtatatatactgtctgtcatagacgcatacgtggatgccgaactatctgattttgacatatccaaagacttaggtcttcaaatacaacctgttatttttaatgacggccggagcaggatacctaatacaataggcctgcaatgcagcttcaaattttaatcgcatgaaaaactttttaattggtttatttacatttataggaacaacgggaataagcgcacaaacccaaagtattaccgttcactcgcaaactacaggaaaagaagaaattattgatgttcctgaaagtatgcagtcagaaatggacagtctttactgggactggcaatctaagaatcacatcacattgggagagaactgcacaatggcctctaccaaccctgttgtaagtgattccatctatatggatcgtctgtcacgtattccctctatcatagaaatgccttacaatgaggcagtacgcaaattcattgatatgtatgccgtccgtctgcgcaataaagtatcctttatgcttgcggcaaccaatttttatatgcctatctttgaagaagcacttgatttatacgaccttcctcaagaactgaaatatctgccgattatagagtccgccttaaatcctgtcgctgtttcccgccagggagctaccggcttgtggcagtttatgctgggtacaggaaaaatatacgggctgaagaacaatagtctgatagacgaaagacgggacccggtcaaatcaacttgggcggcagcacgttacctgaaagacctgtacgacatctatcaagactggaatctggtattggcagcttacaactgcgggccgggcactatcaacaaagccatacgccgtgccggaggagccacggattattggacaatctacaactatctgcccaaagaaacccgtgggtacgttcctgctttcatagcggcaaactacatcatgacctattattgcgaacatggcatctgtcccatggaaacacagcttcccaacgctacagacaccattcacattaacaaagacctccacttacaacaagtggcagaagtatgcaacatcaacctagaccagcttcgcagcctgaacccccaatacaaaaaggatattattcccggtaacagcgagttgtgcgcacttcgtctgcccaataactttgtcagtactttcattgaccgccaagacagcgtgttcgcttataagcccaatgaatatctgaccaaaagaaaaacggtagccatcaaggaaacaaccagtagcagaaaccgctcatccaagggaactctttatcataaaatcaaacaaggagacacattgggaggaattgctgccaaataccacgtatccatcagccaattacgtaatctaaacggtataaagggcaataatatcagagccggaagaagtttgcggatcagatgattgataaaaaatacagatttaacactatacattttctgaaaatacttgcttgaatatgttttttgtatatttttgcagtatagattataggaggcaaagatatgacggatgaaaagcagactcaggaacaggcggatgaggaaatgataaaccaagggtttcaggaacttttggacagttatctagcgaccaagcaccgcaaaaaagtagaaatcatcacaaaggcattcaattttgccaaacaagcacataaaggagtaaaacgacgctcgggtgaaccatacatcatgcatcccatagccgttgctaaaattgtatgtaccgaaataggactgggatcaacttccatttgttcggctttactgcatgatgtggttgaagatacagactacactgtggaagacattgaaaatctgtttggtcctaaaatcgcacagattgtagatggcctgactaaaatatccggcggcatattcggagaccgggcttccgcacaagccgagaatttcaagaaattgctactgaccatgagtgatgacatccgggttatcctcatcaaaatagccgaccgtctgcataatatgcgtacacttggctccatgcttcccaacaagcaatacaaaattgccggagaaaccttatacatctatgcgccactggctaaccgcttggggttaaacaaaataaagacagaactggaagatctcagtttcaaatatgagcatccggaagaatatgcacagatagaatccaagctacaagaaacacaagcggaacgcgaagaagtattccgtgaatttacagcacctatccgcgcacaactggacaaaatgggtatcagctatcaattgatagcacgagtcaaatccccttattccatctggaacaagatgcagaccaagcatatcacatttgaagaaatatatgatatcctggctgtccgtatcatcttctgtcccaaaaatccggaagaagaactcaacgagtgctttaacatatacgtatccatatccaagatttataaaccgcacccagaccgcttgcgcgactgggtaagccatcctaaagccaacggctatcaggcacttcacgtaactctgatgagcaacaaaggccaatggatagaagtgcagatacgcagcgagcggatgaatgatgtagccgaacaaggctttgccgcacactggaaatataaagaaggcggaggcagtgaggacgagggcgaactggaaaaatggctgcgtaccatcaaggaaattctggatgatccgcaaccggatgccatggactttctggataccatcaaactgaacctgttcgcttctgaaatatttgtcttcactccgaaaggtgaaatcaaaacgatgccgcaaaactgtacggcactggattttgcattctccatccatacattcttgggcagccattgcatcggagctaaagtcaaccacaagctggtgcccttgagccacaaactgcaaagcggcgaccaggtggagattcttacttccaaatcacaacatgtacagccttcgtggataaactttgccaccactgcaaaagccaaggctaagatacaggccatactgaaacgcgaacagcgaggtatgcagcaggccggtgaggaaatgttacgggaattcttctccagggagggagtagagtacactcccgaaaacatacgaaagatctgtaatctgcataccctcaagacacaggaagaattgtttgcagccatcggattcaaaacaatcattctaggagaaaacgataaaaacgaactgaaagacaaaccggtttccagtaactggaaaaagtatatctctttcgctttcggaggcagcaagacaaacaaggagaaaccgacagaagagaaggttcccctaccaaagatagacagcaagaaaatattgaaactgactcccgaagctatccaaaagaactatgtgatagcagaatgctgcaaacctattccgggagatgacgttttgggatatataggcgacaataatcgtatcatcatccacaaacgccaatgtccgttggctaccaaactgaaaagcagttatggcaaccgcttgttggctgtccaatgggaaacaggaaagtccttgtacttccctgtaaatatctacataaaaggtattgaccacatcggtctgttaaacaaggtaacagaaatcatttcacaacaattgaatgtaaatatccacaagttgaatattgaaagtaacgatggtatctttgaaggaagaatacagctatttgtgcacgatgtggatgatgtaaaatccatcactaccaacctaaggaaaatagatgagataaaaaccgtcacccgtatcgaaaagttcgaagaccagccgaattaaccaataccagtttcaccgcagattacactgatttgtccataacgattatctgcaactcgtttttaatccgtgcaatctgtggtgaatattcttaagtcaggtaatccagttctttacgcatactgaccaattcctcacgtatcagtttcaatctgtccaaaatctccgtagtacggatagtggtttccctgttcatcttcagtttctgcttagccccctgtaaagtcatccctttctctttcaccagatgatagaccagccggatattctcaatatcctctttacgatactgacggacattccctcccgccttcttgggcgaaataataggaaattccttttcccaataacgcaacaaggattcatttacatcaaacatcttcgccacttccccaatggaatagtaaagtttcaattctttattcggattataggccatggtaaattaaaattaagaattaaaaattcacggctagtcaaataccttaccgtgattggctgcaatctgtatcatcttgtcataatcttccgcactcaaatccatgaaataataattcacaggattctgcacttttcctttcacgtgcacttcatagtgcaagtgcggcccggtactcttgcccgtatttcctacctcccctatcacttccccacgtaccaccttttgccccgggcgaaccttatacttgcttaaatgtgcataccaagtcacgtacccgaaaccatgatccacctggatcagatttccataaccggtttcccatcccgcctttaccaccgttccgtctcccgtagcataaacaggagtacctatattggcagagaaatccattcccgcatgaaacttggctgttttataaataggatctatacgtacaccgtaacctgaagccgtcttcttcaaattcttattggataccggcattatggccggaatacatttcagcatctcgtcatgattcttgcacaaatccaccacctcgtcaaaagacttggactggatataaagctgccggttcaacatatccagcttctgagtggtattgataaccagatcggcattcgccatatcccgcaactgttcatagcggtttgtccccccataaccggccttacggactgcatccgatacaggatcggcctgcaacaccacccgatacaaattatcatcacgctgctggatatcctgcatcacccccatagcctcatccagacgatgggacaacacattatactgggccagcaaacgggtattctctatacggagctccttctcggacggagaaccaaagatcaataataagataatgaaactgcctgcccccaagcccattcccacaaacaaacggcgcaagatgcttaaggcacgctgcctcactgtggggtaaatgcggtcataagttcgggtcttaggattataaatatagtagactttacgcatctaattctgctttttgaagtttttaatgcacaacacatcaatattttgcacaattcttgacgacaaaaataataaaaccaattatctttgcaaatcctttttgagaatattaactagaagacaatatattataagcgacatgatgacagctaaagaaattagagattctttcaaaagctttttcgagtcgaaaggacaccagattgtcccatcggctccgatggtcattaaagatgaccccacattgatgttcaccaatgcaggtatgaaccagttcaaagacattattctgggcaaccacccggccaaatacaaaagagtcgcggactcacaaaaatgtttgcgtgtaagcggcaagcacaatgacctggaagaagtgggacatgatacctaccaccatactatgttcgaaatgctgggcaactggtctttcggagattacttcaagaaagaagctatcggctgggcatgggaatatctggtaaatgtactgaagatagatccgaaagatctgtatgccaccgtattcgaaggaagtcccgaagaaggactggaacgggacaacgaagccgcctcttactgggaacagttcctgccaaaagaccatatcctcaatggcaacaaacatgacaacttctgggaaatgggtgatacaggtccctgcggcccgtgttccgaaatccatatcgactcacgttcggaagaagaaaaagctcaaatccccggcaaccaactggtaaataaggatcatccgcaagtaatcgagatctggaatcttgtattcatgcagttcaaccgcaaagcagacggttcactggaaggtcttcctgccaaagtgatcgataccggtatgggattcgaacgtttggtgcgcacactgcaaggcaagacatccaactatgacactgatgtgttccaaccgatactgaaagccattgccgaaatggcaggaaccacctatggtcaagacaaccagaaagatatcgccatgcgcgttatagccgaccatatccgtaccatcgcattctcaatcaccgacggccagttgcccagcaacgcaaaagccggctatgtaatccgccgtatcctccgccgtgccgtccgttacggatatactttcctgggacagaaacaagcattcatgtacaagctgctgcctgtattgattgagaatatgggcgaggcctatccggagttgaacgcacagaaaacactgatcgagaaagtgatcaaagaagaagaagaatctttcctgcgcacactggaaacaggtatccgtctgttggacaagactatgaacgatgccaaagctgccgggaaaaaagagatcagcggtgtggatgcctttacattatatgacactttcggtttccccctcgacctgacagaactgattctccgagaaaacggcatgactgtaaacgaagaagagttcaacgccgaaatgcagaaacaaaaagaacgcgcccgtaacgcggcagccgttgaaaccggcgactggatcaccataaaggaaggtgacacccactttgtaggttatgactttaccgaatatgaaaccagcatcctgcgctatcgccagatcaagcagaaaaaccagacactgtatcaaattgtactgagcgatactcctttctatgccgaaagtggtggtcaggtaggtgatacaggggtgatcgtaagcgaattcgaaaccattgaaatcattgacaccaagaaggaaaacaaccttcctatccatatcaccaaaaaactgcccgaacaccttgacgttccgatgatggcttgtgtagatacagaaaaacgtgccgcctgtgccgccaaccactcttgtactcacttgctggacgaagcgttgcgccaggtattaggaactcacgtagaacaaaaaggttctttggtaacccctgagtcattacgtttcgacttctctcacttccagaaagtgactgacgagcaacttcgtgaagtggaacatttggtaaatgccaaaatccgtgagaacatccctttgacggaataccgcaatcttcctatcgaaaaggcaaaagaactgggtgctattgctttgttcggtgaaaaatacggtgatgaggtacgtgttgtccaattcggaaactctattgaattctgtggaggtacccacgttccggctacaggcaagatcggtatggtccgtattatcagcgaaagctctgttgctgccggtgtgcgccgtatcgaagctatcacgggtgccaaagtagaggaattgatggatacggtccaagatacgctgaatgacttgaaggcattgttcaacaatgcccccgatctgaaagtcgccatccgcaagtatattgacgaaaatgcaggattgaagaagcaggtggaagagttcatgaaagaaaagggcgccgcactgaaagccagactggtagagaatgccaaagaaataaatggtgtgaaagtggtgaaaaccatcattccgatgtctgccgacgtagtgaaagatattgccttccagctgaaaggtgagattcctgccaatctgttcgttgtaataggtagtgtggacaacaacaaaccgatgctgactgtcatgattagcgaagacctggtaaaagccggacagaatgcaggcaaactggtccgtgaagcagccaaactgattcaaggcggcggcggtggtcagccccacttcgcaacggcaggcggtaagaatcccgacggtctgaatgcggctgttgataaagtgatagagctggctgcattgtaatctattcgaatttcgtccatatttcgtatatatcaaaactccgccatctggtctgaaagccgatggcggagtttttttatctggtttactaagccttttcttctttatggataagggaaataaaaaggaagatttctatctcccaagcctttggagttatctccatagcctttggagttaactccataagcttgggagttaactccaaaggttatggagatagaatacaaacgttcaaaaaggcttagccataaagaaaaaaacattaaccaaacggttgaaaacatatcatcagtcattaacacctcactgactgcccgctcattccgtctgctccttcggccagttcactagatacagaatttccgtagcacgggtgaaagccgtatacagccaacggaaataatccggagtcaacatatcctccgtcatataaccctgatccaaaaagacccgtttccactggccaccctgcgctttgtgacaagtaacggcatacgcatatttcacctgcaaggcattgtaatgaggatcggctttcattttcttcatccgctcacgtttcactgttatatcagcataatcctccaataccgaataaaataacctgtcattcaattctttaggcagtgcgggtgtttcagtatgcaaggtatccaacaaaagtttcacctccagttccataccatcatagtcggggaacgccagcaccacatcggcaaaacgaaagccgtatgcctcacgcacccgacggacacggcgaaccacagctatatctccattggctataaaatcaatctccttacaaccctccgtccaaaaatagttattcttcgccaccatcagcaggtcaccgctgttcagctcatcctcccgaaacagaatcgtattcctaattcccttattataaatattcgcccgtttattggaacggcagaccacaatcgtttcgtccatacctgcctgaccgtaacaatcattgattacctcaatcagctcactaccagaaaccatccggatatccggaaacccttccacacggacagaaggcaaagtgagaaaattttcctcggatatgtagcggcgcaattctgtcgcattccaaagaatccccgaatcatgcatctgacggaccacctcagtgagctgcgcctcatatacttccatgccatacccgcgtaacttatcggccgaaagagccggactctcctcctctcccaccggaggaagctgcgccgtatctcctatcagcatcagacggcaacctgttccggcatatacatattgaatcaagtcgtccagcaaacgccctgtaccaaagaccgcccccgccaatccgtcattagcgatcatcgacgcctcatccacaataaacaaagtatgctgatgcaggttatcatccaaagaaaagttgtccaggtcatttgaaaagttgcgctggcggtaaatcttcttatggatagtataagccggatgctgtgcataatgtgaaaagactttagccgcccttcccgtcggagcaagcagaacacacttttgctgtaactggtccaaggtcttcaccaatgctccgataagggatgttttacccgtaccggcatatccctttaagagaaaaaccgagtccgattggcgggaaaagagaaaatctgctaaaaatttaacagctttttcttgttctaaagttggtttatatagaaaatttcccttaatttgctgcactaaataactattaatcataattgcgtaataaaaagttccttgaactgtgcgttattagatttatttgttttatttttgcgatgcgaatataaactaaaaaaaacacatatttatcatgaaaacagttattaatattgtattggctgcttgcgttatcggtttgatatacgtttgctacggcagtatcatgggaccgatcaacttcgatgacgctaaaaagactagagagaaacaagttattgcacgcttaattgacatccgtaaggcacagttggaataccgtaacctgcacaatggacgatatactgcaagcttcgacaccttgattgatttcgtcaaaactgcaaaacttccgtttgtaaagaaagaaggagttttgtctgatacacaactggaagccggtatgactgaaaagaaagcgatggcaatcatcaacaaagccaaaaagaccggtaactggaaagaagttgaaaaagaaggtttgatgaacttcaaacgtgatactttatgggttgccgtaacagatacaatctatgctccgggcttcaacgcagactctttgagatatgttcccttcggaaacggcgtacaatttgagatggttacccgcagcgatactaccaaatcgggtgctcctttgaacttgttccaagctcaaactccgtatgaaacatatttgggcggcttgaatactcaagaattggctaaccttaaagaccttcagaccaaattgggtaaatattgcggtttaagagtgggtgatatcgaacagcctaacaataacgcaggtaactgggaataagaatgactgaacgtatcgattttacaaaatcggaacaatatacattatccatccgcctcagtgcggatggattttctttttctatctataacccactgacagataatgatttctgctttgttccgcatccggtcaacaccggatattccatgacggccaatctgaaagatatgctgactaaaacagaagcgctgaagtatccgtataaacgggttaacatcttgtatgactccccccgtttcacccctgttcctttggaattattcgaagacgaacagatggatacaattttctatcataattttcctaaagctaaaggaaataacgagattgtactttgcaatgtcctgggaagaagcaatgtggtaatactttttgctatggacaaacatacccatttgttactgactgaacattttcctacggctcgtttcttctccaccgccagcccgctgactgaatatttcgcccggaaaagccggttgggtaacagccggaaactatatacatacatacgcgagcaacaaatggaagttttttgttttgataagggcaacttattactgatcaactcatttccatgcaaacaaaccacagaccgtgtgtattacctattatatgtatggcaacaattaaattataatcaggaaagagacgagctgcacttgacaggaatattaaaggacaaagaagaattactgaaagagttgcgcaattatctgcgccaggtattcgtcatcagccccaaagcggaattcaaccgctccgagataagtaaaatagaagagataccttttgacatgcaaaccttattattatgcgagtaatcagcggtatatacaaacggcgccgtttcgatgtgcctcatacattcaaggcacgtccgacaacggatttcgccaaagagaaccttttcaatgtattaagtaacaattattttgacttcgaggacggagttacagccttggaccttttcgccggtacgggcagcatcagtatagaactggtttcacgcggttgtgaccgggttatttcagtagaaaaagatccccagcacctttctttcatctcacaggtgatgcgtgaagtgaagactgacaaatgttttcctatccgtgctgatgtctttagatttatagacaaatgcagcgagcaatttgatttcatcttcgccgaccctccatacgccttgaaagagttggaaagcatccccacccgtattttcgaaagcgggattttaaaggaagacggattactggtactggaacatggcaaagagaatcattttgaggatgacccccattttattgagcgccgtgcatatggcagtgtgaacttctctttcttcaaagcaacggtgccagcaaccggacaatagattcttgtgctttttgataccaaggacgctttatccatgtttttctctgcaacaggatggcgtccttctggtcttgcaggaaaatacctttcaacagcaatgctgaggacggatcatacataaaggcattcacctcaaaattatgctcaaagctacggaagtccatatttgtagaacctaccgtagaaagagtatcatcactgaccatcagcttggaatgcaaaaaacctttctgataaaggtaaatcctgacacccgcacgcatgatatcatccaaataagataacgaacctaaatgtgttatccatgtatcggcacgtgccggtatcataatgcgaacatccacgcctgccaaagctgccgttttcaatgccatcagaataggttcggtaggcaacaggtaaggtgtttgtatataaaaatactttcgggagctgctgatagctatcagtagcccttgcataatatcccgccattcgcctacaggatcggaagtgacaatctgtatcagagcctttccaaagattccgacttcggggaaataacgggaggaagtgataagggtacggtctactacataccaatcggtcaaaaaagcagtctgtaacccatataccgcttttccttctattttaatgtgagtatcccgccatatcccccatggaaagcctttcatatagcgcaaagcaatgttcatccctcccgtataagccacacgaccgtcgattactactattttacggtgattacgataatttaccttactggtaaataaaggaaaacggactttcaaaaaactgcgtgcctcaatacctgctccccgcatttcatcaaaaaaagcatggggaactttccagcagcccacatcgtcatatagtaaacgcacttctactccctgccgcgctttatctatcaacaaatcgcgcagcaacctgcctgccggatcatcctcaaaaatataaaactgcaaatggatgtgatgctttgccttactgatttctttcatcaatgaatacagcatggaataaccatccgtaaaaacttccgtcgcatttccttcaaagggcaaagcattattcactttccggaaaaaacgcatcaactggtactgttcatcaggacacttaaacgccttttgcgcctggtattctgccatgggacgttttatgagacgggtgaaccctttcttgctgatcaatttctccttacgtgtgcttctgccgaaaaagaaatagaacacaagccccacaataggcaggaaaaagagcacaagtacccatgccattgttttaacgggattacgattatcaagtatcactataaagatagttccgatgataatcacaaaataaagcacgttaaaagcaacagcaaagatttcattaaagatactccactctaccatataattccagtaatttacttataagcaaacttataaaaaaaatcccaacctataacaatatagattgggaaaagattaagatatagtttcatttaaaaaggacgccggccatgtcttcccggaccgggaccaaaaccgggactgccgaatcccctatggctattcatcatcttgtcacgggcggctttacttccaaaaatattcagacgatagataaaatgtaccatacaataactgttgatactgttgtattcggtaaccgaacgtacatccgctgtcaaagaacggctgatattgctctgttgttttaagatgtcgtacatttcaaaactaacagttgcagctcctttcaatagactttgtgctatttgggcattccaaatcagttcattattgttcaaactggcatcatcatatcctctacgggactggttggtgatattagtagacaatgtcatctgccatggtaaagtgacattggtactcgctccatatgagaatgtataaggattctggttcttttcaggacgcagcttgctacgttccgctgtatactcaatagaaccattcaatgaaaattcaaaccagtcattccgataggacccattcagattctccgccaaagtcaaaccggtagtcgtattcttatcatcatgcaatgtttccttattgtataagaacgctacctgattccggtagctcacacgagaaaaagaatttatagtaaactttttattcttcaaagccgaattaaaaccgaacaatccaaacgcattccagtttccattgatattctgaggagttgaagtagtaccacccgtattctcatcatataccgtactattactgatactattctgagtagcagtgaaatttacatgagtcattatgccacgctgcttctcggcattataagtgttataaaacaaacgcatggtatgggcaaacgaaggcttcaaacctggattacccacacggatattcaacggattggaattatcgacaatcggcaacaggttttccatactaggctggctactacgcccacgataagtgatacgcaactgacttactttggagaagcgataacgaaaatccagattcggagcaaaattaaataccgttcttgtggtatcagtcatgtaatctcccttcttataggacaatttcgtattttgaggctgtaaggacatgccggcactcaactgatatttctcccggataaatcgtagtcccaaagaaatatcatgattaaagtatttatattcagcatccttactcaagctatccacataagcagtttcatagttttcgggtaatccgtcatttatatcccaaggataccccaaatcgtatgtcgatttatcactcttgctattcttatattggaatctataactaaattgcaggaaagtagcccgtgctataggttcgctataagtaaactgtgctgtataattataatttttagtaggcatcgtaatgtattgattacgatgttctatagaatcccctcctaaatagttctttatctgataataacgggtttccgattgagcatactgatcgctgtcatcatctccatatccaaatgaaccacggaatgtaatgttacgtccctcattattcagtttccggttcagctgcaatgttgcattagccgacaaactatttgatttggacagattatgttcattggtagcattaatacgagtatcccttaacggatcatcagaccctatattgtcaaagttcaaataatcattgggatttaccacatactgataaggatcctcattaaaagtacctgactctgcaactgaagctccccttgtcttatcataagaaacattcggccggaaaataatattggtcattgaatcgggacgccattccatacggaaatctgccttgaaacctgtttccttattactattggctttgtttgaattggaataagaatcccccgactgcaaaaaacgctgtgaagatccgactgttactacatctgcatcacgatagttgtaacgcatactacctcccaattccagtttttctgtttctgtagcaaaattcgctcctagcattttagtcgcgttcaatccattgttacgcctccaacgaggtcctccccccgaaaatccctgatcattcacattattggcggaaccaataatagaaacctgagttttatcataaaaacggttaatcatagctcttcctgtataacggtcttccgttccggcgcctaaatccacgtttccaaaccagccttgattcatccccttcttcaccgtcaaatcgagcactgtttcctcctcaccatcatcaatacccgtaatgcgtgccaaatcggatttcttatcataggttttcagtttttccaccatatcgactggcaagttcttcaaaccggtcttcacatcaccgccaaaaaactctttgccatctaccataagtttcttgatttccttgccgttcatctttatgtttccgtcttcatctatttctgctcccggaagttttttcaccaattcttccaacatcgccccctcaggagtacgataagcagaagcgttatagccaatagtatcttctgaaatggttacctgcggagcctcggctacaataaccgcctcacccaacatgatagcatcggtgggtaaagtgactgttccaatattaacactcggtttaccagctgtcagctgcaaagatttttcctgagtaaggtaacctacaaatgaaattttaagtacatatttccccggacgggcagcaatagagaatactccgttgttattggtaacatttcctaccaccattgtactatcgggtagagaaagtaactgtacggtagcttgtccaaccgggcttttatcatcaccatcaatcacagatcccgtcacggttatgcgcttgccactttgcgcccaagagagagttgcacaggtacataccagtaacaacaataatactaacttcttcattttttctttttccttgaaattttaatgcctaatgtcctttggacactcttgtcgacaaaaggtttaacggaaaaatgtatttatttcttaaacaatcggtcaacccggcttttttgtacaccaaattccagacaaataacattaaaaaccatataaactatagcaatggaattatccgcttcttccagatttccattatatactcctctgaccaacattacaatataataaatgcccaacaaataaatagcataacaaatagccttgatacgtattcgggaaatcttctcattctcatccttcacttttgccaagaagatcataaacaaagaaaaccagataagtaacttgatagaagcctttgtaaacaacaggttactatcgtttatcatgccaaacataaacatgaacaacggtacgaaaacagacaacaacagaacaacatatcccatcgtcctacaataaaccggtaaaattcctttcattattttatattttaacgtacaaaagtaattatttgtaagcaaagaacggtcatctttttgcttttttacctaaatttgcaggcaaataatagaaaatatgagtaaacaagaagttattatctgccataacttagaagaaaatctcaataaggcaataaaccaatgcccacatgacaaattatttgtcttggctgacgaacatacacgtgaactttgcattcctgttgtatcagaatttgattgtattaaaaatgcccattttatttatataggggctgaagatgtgcacaaaaacttggaaacactggcatatgtatggaaagagttgggagataaaggtgcaagccgtcattcgctacttatcaatttaggtggagggatggttacagatttaggaggattcgccgcatcaactttcaaacgagggatcaaatatattaatattcctaccacactgctggctatggttgatgcatctgtaggaggcaagaccggaatcaatttcaacggattaaagaatgagatcggagtcttctctcctgccgaaagtgtattgattgacgctaattttctaaaatcactggatattcgcaatctattgtccggatacgctgaaatgttgaaacatggtcttatcagcacccatgatcattggatagaattgttgaaatttgacttcaacaatatagattacaaggtcttacagactttagtcggaaaatctgtacagattaaagaagatatagtggaacaggatccttttgaaagaggaatccgcaaagctttaaatctgggacacaccgtagggcatgcttttgaaagtctggcattagaaacacagcatccgatattacatggttacgctgtggcatggggaatagtttgtgaactttatttctcccatatcaaaactggttttcctaaagacaagctacgtcagaccatcctgttcgtcaaagaacattatggagttatgccttttaattgcaaacaatatgaacgcctctatgaattcatgaaacatgataagaaaaactcagcaggcattatcaatttcaccctattaactgaaataggaaatatacagattaatcaatcggcaagtaaagacgaaatttttgaaatgctggatttttatcatgaatccatgggttgctgatctcccttcaaacagatggaaaggattgtacaaactttccatctgtccgatacaataaaaacatcttttatttattcccaattataatcgatcaaacttttaacaatcaagcaattagagtatttataatacattagttaaaaaacagaccaatcatttaaaaaagacaaatataaagcaccttttttccgtaaaattgttcctaaataccattgatcaacttttcaatgcttcagaaaccctatttttgcattatataattggttggtataaatgttatataaggaatttgaaaagaatagagaagatatattagagaatgaattttgcatgcaatctaatgcatcaacattgcccattacagattgcccttcttatacccctatatgtactattggaatctgtatacaaggaaatgctaaaataagaatggattctcaagaatatactatacacccacatgatgtttttgtctttatgccgggactgctagtctcagtcatagagacaagtcctcatttcacaacaaactattttacactttcaaacacatttttctatgatgtaataaaaactatcaggagtttttctcctcaatttttctcttacatgaaatctcgtttcctttatcccttgccggaacaagagatgcagtatttcatgaattattatacgttactgaagagtcggatcaaacttcccaaaagtttttccagagaagcaattatagctctgctaagaattatattcctagatttatataacgattttgaaaattatatcaatcatagaaataatacaagtacaacacgtaaagaagatttaacgcatagattctatacgctaatgatggacaactacagagagcataaagaggttatcttttatgccgacaaacttcatgtttcttccaaatatctgtctgaagtagttaaagaaaccagtggaaaatctcctaaggactggattatagattattcattactggagataaaagaattattgaaaaacagttctcttaatattcaggaaataacaatcagaactaagttcctgaaccagtctgctttaggtcgtttttttaaaagacacaccaatatgtctccctctgaatatagggaatcgacttattagtttcatcaataccttgcataaaaagatgcacttttaatgtaaaaaagtacagagaatatttgcaaataccaaaaaaagccgtacctttgcatccgcaattcggggtgtagctcagcccggttagagtacgcgtctggggggcgtgtggtcgctggttcgaatccagtcaccccgacaagctgagcatgaaggagtttagtgaaaactaactccttctttttattatactacccaacattgatcttaccttaccgaaaccaatattcggggcccagcggaaatttcgcatcatcagataaataaaaggggcagttcttatgtgtctctctcgtattcgttatacagaaataacattaatgaaaatataacaaataaagctgttaaagaactcatcaaccaaaaacctttttcatacctttgctctacaaatttcatgaagatgtccgaacgcaaaataatacatatcgatatggatgcattctacgcatcggtagaacagcgtgacaaccccgaattatgtggaaaaccgcttgctgtgggacacgctgaagaacgaggtgtggtagctgctgccagttacgaagcccgtcgttacggagtacattccgccatgtcatcacaaaaagctaaaagactttgcccagaactgatttttgttccagggcgaatgaatgtatataaagctgtatcccggcagatacacgatatctttcatacctatacagatatcatagagcctctgtcactagacgaagcctttctggatgtaactgaaaataaagcaggcttttcacttgctatagatatagccaaagatataaaaaagcgtatccgcaaagaattgggattgatagcttcagccggggtctcttataacaaatttctagccaaaatagcatcggattaccgcaaacccgacggattatgtacaatacatcccgaccaagcattggatttcatcgcccatcttcccatcgaatctttttggggagtaggtccggtcacagcccaaaaaatgcacgcattaggtattcataatggtacccaattacaagcctgcactttagaaatgcttacccgacagtttggcaaagcaggtaatctatattacgattttgcacgaggcatagacctccgtcctgtagaacccataagaatccgtaagtccgtaggatgcgaacatacattggaaaaagacatttctcttcattcttccgccatcattgaactatatcatgtagtcaccgaattgctagaaagactgaaacgcactaatttcagtggtaatacacttactttaaaaataaaattccatgactttaaccaaataacccgcagcatcactcaagacagtgaactgacaagcatggataaaattcttcctttagcaaaaaaattactgaaagaaattgattatgaaagccaccccatccgccttatcggactatccgtatctaatccaaaagaagaaaaagaagaaataaaaaaacaatgggaacaactttcattggaatttaaagagtgggatgattaaggtactggataaatgaatcaatataagattccattgtttcaaaccctttcactccattctttaattctaatccataatatattcccgccagcaaacctgtcaatgctcctaccgcatcacttgacttacctgagtttatagccgaaaatacgcactccttataactatttcctgccataaaccaattgaccactgactccaccgtatctacaacaaagcttccattacaaagattttgcctgttaacctccacaccacatctctgctcagcctgctgtaatgcctgtcctttatcttcatattccaacaggcaacgaataaactcaataaaaaaccaagtatacttaaagctataacgactattatgagtaatcttaataaaaggaaaaatctcctctttagataaaggcgaaaaagccaaaacacaacatcccatcaaactacggttgccgctattagaatccgaagacactcccctgaaatttttcatgattgctttttgggtcacctgatcaatatcaaactcaatgttttctcctgtatactttctattaaaataccaatctcttaaattctgctgataaagttccaaattacaacgactgtccaaagcacataataacatcgaagtatttcctgaacatttgtctccccgaagataagattttgtccacataggtttaaatgtcccttttccttttcccctgtaaggcattcccaaccaatctcctaatataaatcccgttagtcccgttttaattcttttcatggcatgtgtttaattacaaagtacaaaaataataaaaagagaaacaaaaccttgccttccgctgttaaattcataattaatgggtattgataagtatgtatgctacaactaattttgccaccaacagaaaatgtattaccgggtaataaagaaaggagaacaaatgaaaagaatcgtattactccgccatggagaaagtacttggaacaaagacaaccgttttacaggatggacagatgtagatttaaccgaaaaaggtatcgctgatgccaaccaagcaggtatactcttaaaagaaaaaggatttcattttgataaagcttacacttcttttttaaagcgtgcggtcaaaacattaaactgtgtcctagatcaaatggatcaagactggatacctgtagagaaaagttggcgcctaaatgagaaacattatggcgcattgcaaggattaaacaaaagcgaaacagcttctaaatacggagaagaacaagtcttgatatggcgccgtagttttaacgtagctcccaatgccctaccggaagatgatccgcgcaatccgaaaacagatacccgttataaagaagttcctgacaaagatcttccacgtaccgaatctctgaaagaaacagtagaacgtatattaccttattggaaatgcatcatcttccccaatctagctacagcaaacgaactgctggtagtagctcacggaaacagcctcagaggaattattaaatatttgaaacatataccggatgaggaaattgtaggtcttaatctacctactgctgttccgtatgtattcgagtttgataatgacctgaatttgaagaaagactactttttgggagatccggaaaaaataaaaaaactaatggaagctgtagccgatcaaggaaaaaccaaccccggtggcaggaaataattttcctgcgctgtccgaaacctccatcacagaatggagaatacatcaaaatagtgttttcaatagtgcattcaaacgcaatcatacgcttttatactagaaagaaaacattatggataaaagattattaatcaattaaagaaaaaagagtatgagtaaaataacaaatttattgggtaaccaagcagcattttatttagagcacacctgtagaactatagataaatcattaatccatatcccttcttcaagcaccattgatgatacttggatatcatcagaccgcaatattcgtaccctgagcagtattcaaaccctgttaggacacgggcgacttgcaaatacagggtatgtatctattcttcctgtagatcaaggcatagaacatacagcaggagcctcatttgctcccaatccactttactttgatccggaaaatattgtaaaactcgctattgaggggggctgtaatgccgtagcctctactttcggagtattaggttccgttgcccgcaaatacgcccacaagattccttttattgccaaactaaatcacaatgaattattgacttatcccaattcttacgaccaagtgatgtttggtactgtaaaagaagcctggaatatgggggctgtagcagtaggtgccactatctatttcggttctgaacagagccgcagacaactggttgaaatagcggaagcttttgaatatgcccacgaactaggcatggctactattttatggtgttacttacgtaacaatgcttttaaaaaagacggtgtagattatcatacagcagccgatttaaccggacaagccaatcatttgggagttactatcaaggcagatattgtaaaacagaaattaccggtcaataacggtggttttacagccattaaattcggaaagacaaatgataaagtttataccgaactgacttcagaacatcctatcgacctctgtcgctatcaagtagccaatggatacatgggacgtgtaggattaatcaactctggaggtgaatctcatggcagttctgatctaaaagacgcagtaataacagcaatcgtcaataaacgtgccggaggtatgggtctcataagtggacgtaaagcctttcaaaaaccaatgaaagacggaattgaattgctaaataccattcaagatgtttatttggattcaagcatcactatagcttaactttcactatatgtccgggccgggaacaaaacaaccacctttccatgttcccggcttttttatactctccggcctccttttttaagtagcaaccttcaagtattaagataatattcctacctttgcaatccgatacacattattatattatataaggtatgatgcaaataaaagtaacggcacccgctcaaatacatacaactatccagctcccctcttccaagagtatcagcaaccgtgcattgataatcaatgcactgggaaatagaatattccaacttgagaacctatctgactgcgatgatacccaagtaatgattcacgccttaaatgacggcaaaaataccatagacattatggcagccggaacagccatgcgctttcttactgcttatttgtccgtcactccgggaacacggatcatcactggtacacaacgtatgcaacaacgtcctatccaggtgttggtcaatgctttacgtgagctgggagcagaaattgaatacataatcaatgacggatatcctcctctgcgtatcaccggacacaaactgcagaaagataccatcagcctgccgggtaatgtcagttctcaatatatctcagccttattgatgattgcccctatactaagtaacggactgacccttacactgacaggagaaatcatatcccgcccttatatcaaccttaccctgcagctgatgaacgattttggtgctagagccaaatggctcaatgaatatcaactaaaagttgagccgcaaccctaccaatccatacctttctacgtggaaagtgattggagcgcagcttcatattggtatcagatagccgctctttccaacaaagcggaaatcatcttaccgggattattcgaaacaagctatcaaggggacagtaaagtggctgaaattttccagttactaggaatcgaaagtatttatggaaataaaacggtaacattgaaaaagaccgataaaataaccgaacggctggattatgatttcatcaaccaaccggatttggcacaaacgtttgtcgtcacttgtgcgttaatgaatattcccttccgcttctcaggcttacaaagtttgaagattaaagaaacagaccgtatggcagccttgatacaagaaatgggaaagctaggatatatacttcatgaaacagatgatcgtattctgtcttgggaaggtgaacgatgtgaaatgaccgctgatgttgccattgacacttatgaggaccaccgtatggctatggcattcgctccggcttgtgtagtaatgcccgaaatccggattaataatccacaggtcgtttcaaaatcctatccttactattgggaagatttaaagaaagctggttttataatagaggaggtataaagttatgctcatacttattattggtctgattattttggcaggtatcgccatgacagtgggagttttacacaaccgccagatacaaaaaaagatagaaagcggagaattgaaggctgctcccgaaatagtggaagcagacgctgaatgttgtgggcaacatgaaatttgtgaaaaagaaagcctgcttgccgctgtcagcaaaaaaatagaatattatgatgacgaggaactggaccgctttcgcggccgtccctcaaatggttataatgaagaagaagtggaagaatttcgggaaatcatgtacacttgtaaagaagatgaagtagccggatggagccgtagcctgcaattgcgtggaatagaactgccggacgagttgaaagacgagcttttcctgattgtaggtgaacgaagattcaaataatccgcctacaccaagcaaagtctccatttgaataaaaaccactgaaaaaaatatggatatattagaacttttgcattatactttcttccaacatgccttgctaggaagcttgtttgccagcattgcctgtggcattatcggcacatacattgtgacgcgccgtttggtattcatcagtggaggaattacccacgcctcttttggaggtatcggcctaggattatacgcaggaatctcccctctattatctgctgcaatcttctccgtactctcttcctttggggtagaatggttaagcaaacggaaagatatgcgcgaagattccgctatcgccgtgttttggactttcggtatggcagtaggtattatctttagctttctagctccaggattcactcccgatttatccgcctttctgttcggcaacattctgaccattacgcccacagacattctgttacttgccattctttccgtgctgctgacactattcttcactttatttctgaatcctatcatttgcatcgctttcgaccgggaattcgcccgttcccaacgtataccggtagctttatttgaatatattctgatgatgttcatcgcactgaccatcgtatcatgcctccgcatggtaggtatagtacttgccatttccctgctgactttaccgcaaatgaccgccaatttgtttacccatagtttcaagaaaattatctggtggtctgtcatcaccggttatgcaggttgtttaggtggactgttcatttcttataaattacaagttccttcgggtgcagcaataatctttttttcaatcctcatctatactttttgcaaaatggggaaaagcatgtacctttgcaaacaaaagaaactcaatcaaaccaatggatatggaaattaaaatcaattctttagactctatccacgaagctgccaaacaattcatcgcagctatgggtgataataccgtttttgctttctacggaaagatgggagccggtaaaacaacatttatcaaagctgtatgcgaagagctgggggtaacagatgtcatcaactcgccaacttttgccattgtcaacgaataccgttcggatgaaaccggtgaacttatttaccattttgatttctatcgtatcaagaaactggacgaagtatacgacatgggatatgaggattatttctatagcggtgccctctgcttcatcgaatggccggaactggtagaagaacttttgcctggcaatgctgtaaaagtcgagattgaagaatctgaagatggaagccgcatcatgcactttgaagctgaataaaagaaaaatattcactgtagggacgaacaaaatctgcccctacagccaaattcattaaattatgggaatgcattatctgatccaagccatattcgtattggtaggactattgtccgttctggcagccttatttaattgggagtggttctttaccgcacacaacacacagttcattgtcagtaatgcagggcgtcagcgtgcacgacttttctatgctatattaggactattaatgatagctacaggcatttatttctttttgaatatacaaggcatcgtataaacacatagtgaacaaaatctgtggatattacattcccctatccacagacataaaacaagttttttaggaaagagcaggatttccacccgccccctgttataacaaaaatccaaatcaatctacaatttcagccaacagccccctagtttcatcaagatcaaattcagtaggatcaaaattataccccaaccattctttatattcacgcgcagctttagagcgaggcttttctaaagctttcagcattttcctatacccccatatgccattacaatcttctggcggacaagcattttcaccatccaacaaggctataaccggaatttcctctttcttataggactggcaggattctaatataatttcatgtatccaactatcaccgaaatcatattcatacttaatttttgatcccttacgacttaataattcacctaaagaaagcataccggaatcaaactgtttgggtacaccctcaaaaaaacaatcatctgcccgatctttgggaggaagataataagtgttccccttaataaaacgatgcaaatgataaccatcccatcccattgccacttctaccacctcagaaaatctttccaaacaaatattcgaaggaacctccaatatgcgccagactaatggttcagagtctttcaactctatttttattctaaattttttagcaggctgctcctccatataaagcggatcatcataaatctcctcatcttcttcctcgtcagtagcaacctcgaaaacttcaactagataatcctctacccgttccatttccaacccatgcatttccgcataaggcatttttttctttagttcattaatacttggaataccataaggtttaatatgataagtccgataaatcttttgcaaaataggtaaagtttctaccccgcgaatatccatcatgcaagctgtaacatgatcaagcagcaaagtagaacaaatatcattcttctgctctttcagtacatcaaaatagtaactcaacaaattaccaaaccaatccatcacttcctctcttctgtcaggatgagttatcacaatatgagcaacagcttcaatcactctatatttagacataggaagcagtccgggctctttcataaagtccatcaaaacatctaattgattctgtcccaattgataggtaatggcagacaacattgtttcatacaaataaccgaaataaaaatcataaaaatccaaatcttgccgcagcacttccaaaacaatatccaaacaatgttccatacgaaaatgctccattattcctaatgcataccacattctatatgaataacatttttcgggcattttccgatatacgacaaagatattaaagataaaattgcggagatctcgttccaatgtttcttgtggaataacagcacaagaagagtagatttcagccggtgacagactactcatatcatccatcgtccacaaaggcatcagataagatgcgatcggctgcgcaatcaatctataatcgggacactgatgatgataataaatatgagacagttcttcatctacctgattcgctccatcattaaacaattcaaatgcaatttcttgttcttccggggtcaataaagacatgatatcctccaaaagaccaggtaggaattgggaatttttctttttagccattaagcaatgtttttatagttaaaatgagcatgagtgtttttacaaaggtattctattattttcttttacaaaagaaataagagagctaatagtagatactaccttgttttcaagtataaaaaaatgcgcatcccccacatagagatacgcatcttttattttattatgagactttcttcttaatccacttgtcccaatgaattcccatattccatttccccttggactacaaagaatacatcatcggggtcataaggccccattccgtctttcttggcttccttgactatgtaattcacaatttcatcttgatcaatgttaatgtatccctcttcatcaggttgtacatcaagacatccgctggaggtatagtaatccacaatcacatcaaggatataatataaatcatcctccgtgaatttatctttcaaatcctgaggcagataatttttgataaactctatcgttttttgatcatcctcatcttccaataagaaatcgtcttccattcccatagtcgtatatattaaaggggtgaatattctttttattacagtaaagcttttattttttcttccagctgagctttggtcactgcacctacagtcttatctttcacttcaccgtccttgataaaaagaacagtaggaatgttacgtacaccaaatttaccggtcagttcgtcgttatcatccacgtcgcactttccaattattacctgatccttatattcttctgccaaagcttcaacatccggagctatttttttacaaggaccacaccatgttgcccaaaagtccactactacaggcttgcctgatgccagcaattcttcaaaattgctatctttaatttctagtgccataattattatacttagttatttaaaatgttagcgcaaatatactaattaattttgtaagagagctgtggttggctctttaaataagtcatgatctctttttgaactgaaattttcatagtacgtgacatcagattgacatacatttgtccatcctcatccatcacatgaaaataaagctctgcattaccgggatgtgccttgattaaggctgaaaactccgttatcagctcttcatccaatgcagacaaaggagctgaaactgtaagtttctcaataatcttttcctttacttccggtaacaactcaatagtacttatcttcacctcccattcttcctgccgccattgttttggctgacatttccctcgcataaataaaaacataccggtcataaaaaagttcttcttctctacccattcattaccgaagaaagcaaattctgctgagcccgaataatcttccactttagcaataccgtatggttttcccgtcttggtgtacccctcacgcactgcagtcacaatccctcccatggttaagtctctgttctgcaaaggggttaaatcggcaagttccgccatgtggacattgcatacattctctaatataacagcatactcatccaacggatgggcagaaagatagatacctaccaaatcacgttccttattcaaacgttccaaatccccccatgcaggagacggaatgatttcgggagtagcaatatccacctgattctcacctccaaacaaagaatttgcagctgcggctttatccatctgatacttatttccataacgtaccaacacttcggtaaaggtttcatctttagcgttctttacaaagaagtcttcacgctttattcctgtgaaactatcaaaagcacctgccaaagccaagttttctatattcttacgattgcaagccgaaagatttacacgctgtacaaaatcgaaaatatctttatattctccatttctctcacgttcttcaaggatagactgcacagcactttcccccactcccttaatggctcccagtccaaaacggatatcccctttacgattcacagaaaacttcagataactttcattcacatcaggtcccttggtcatgataccagtcgccttactctcgtccatcaatttagtaatttccgtgatattcgaaatattccggctcatcgtagccgccatatattccgccggatagtttgctttcagaaaagctgtctgataagccacccacgaataacaagtagcatgagatttattgaatgcataagaagcgaacttttcccagtccgtccaaatcttctcaagtactttgggatcatgaccgttctttcgtccgccttcaataaacttaggcttcatatggtctagtttgtccctcagttttttacccattgctttacgcaaggcatcggattcgccacgagtaaaatccgccagcaaacgtgacaaaagcatgacctgctcctgatataccgtaataccatatgtatctttcaaatatttctccataataggaatatcatactcaataggcttacggccatgcttacggtcgataaagtccggaatgtaatccataggtcccggacgataaagagcattcatcgcaatcaaatcctcaaaagtgctaggttccaattcccgcaaatatttctgcataccggcagattcgaactggaatgtaccaatcgtccgtccttcactataaagagcataagtaggaggatccgaaatgtcaacctcgtcaatatccaagataatccccttactatgcttgatattttcaatcgcctctttgataatagaaagggtcttcagacccaaaaagtccatcttgatcaatccagtatcttcaataactgaaccttcatactgggtcaccagcattttttcaccggtttccttatcatctgccgtacttacaggcacccagtccgttatatcatctcgacatataatagtaccgcacgcatgcacacctgtattacggacattcccctccaacatctttgcatactttatcgtatcacgcaaaataggatcgggtgagacttccgctgcctgtagttcgggaacataagctatggcattaggcaaattcatttttttatcaggaatcttatccggaaccaacttacacaaacggtcggactccgataaaggtaatttctgtacacgggctacatccttgattgccagcttggttgccatcgtaccgtatgtaatgatatgcgccaccttttcctgaccatatttttcagttacccaattcaatactcgtccacgaccatcatcatcaaaatccacatcaatatcaggcaaagaaatacggtcgggattcaggaaacgttcgaacagcaaatcgtatgcaatagggtctattttagtgatacccaaacaatatgctacggcagaacctgccgctgatccacgtcccggtcccacagacacatccaattcttcacgcgcggcacgaataaaatcctgcacaatcaagaagtaaccgggaaaacccatcgtcttcataatatgaagttcgaatttgatccgttcctgcacttcctcactcaatacttctccataacgcttatgcgcaccttccaacgctaatttcttcagataatcagcttccagtttaatacgatagagtttgtcatagccacccagtttctctattttggccttagcggcctcctcactcattaccacgttaccgttttcatcttgagtgaactcatcaaacaagtccttttctgtatatttcttccgatatccctcttctgttccaaaatcttcaggaatagcaaaagtaggcataatcggtgcatgatctatactataaaattccacctgatcacaaatatccaccgtatttgaaagagcctcgggaacatcagcaaaaacttcattcatctcggcacgtgtcttcatccactcttgctttgaatagagcatacggttaggatcatccaaatccttacccgtactcagacagatcagcctgtcgtgtgcttcagcattctcttcatctacaaagtgaacgtcattggtacaaaccagcttgacattgaattttttagaatactctatcagcttttcgttagcaatttgctgcaatttataagcttcatggttcgcacgaggaaccgtcgctttatgacgttgcaattccaaatagaaatcatctccgaatacacgtttataccattggatagcttcctcagcctcttcatattttccagctatgatatttctaggaacctctccggcaatacacgcagtacagacaatcaacccttcatggtatttttccaattccacacggtcagtacgcggacgcatatagaacccttccgtccatgcctttgatactaattttatgaggttgtggtatcctttttcatttttagcaagcacaaccaagtgataaccactttgatcgggttttccttctttgttgaataaacgacggcgcgccacatacatctcacaaccgaaaatcggtttaaacagtttcttctttgccgtttccaatttttccttgcatgccacaagttccgtctcgggattatcacattccaccgtacctttttccagtccggctattcttttcttcaaatcctttatctcactgttagtactgctattcttcttatttacatagttgaagaattccttgataccgaacatatcaccatggtctgttacggctatacctttcattccatcagccatagccttgtctaccaaacgtggaatagacgcctggccatcaaggatggaatactgggtatggacatgtaaatggacaaaatcctgcataatcgttactctactaaaaaattgtctaaagatactctgctttcataaaacctgcaaaaagataaagaagaagttatcaacattcgctttttttatcttaaatgaagtcgaaataggcatttctaacaacttttatttgcaaggttttcaaaataagtttatttttgcacgataattggttttatacaatcatgaaccgactgaagaaattaaagaaaataagactacatagagagggaacaagcatcttaattgtcagtgccatcctgttaattggtatcaatgccctattgttttggggaattgagtgcaaaattccattttatatatttgccaccgcaagtatcgttgtttacctgttaatggttaactttttccgttgtcccattcgattattcgagcacgacactgaaaaaatcgtagtagccccggcagacggaagaatagtagttatagaagaagtagatgaacatgaatattttcatgaccgccggttaatgatttctatttttatgagcattgtcaatgtacatgccaattggtatcccgtagacggagtagtgaaacatgtagaccatcataacggtaaatttatgaaagcatggctgcctaaagccagtacggaaaatgaacgttctatggtcgttattgaaactcctgaaggacatactgtcatggcgcgccagatagcaggagcaatagcccgtcgaatcgtgacctatgccgaagtaggagaagattgctacattgatgaacacatggggtttattaaattcggttcgcgtgtagatgtttatctcccactaggaaccgaagtctgtgtcaagatgggacaagcgactgtaggtaacgaaaccgtcattgctaaactaaaataagaaaatcaccaatggcaaactgtatcacacgccacattcctaacgcggtaacttgctgtaatttattctccggctgtattgccagtgtcatggcttttaacgaaaactataccttggccatctctttcattatactaggcgctgtatttgatttctttgatggcatgttggcacgtttattcaaagtatcagggcctttaggaaaagaattagactcgttggccgatgacatcacttttgggttcgctccttccgccattgtcttttctttatttaaagaggtacactatcctgattttctattgcctgttgccgattatatgccttataccgcattccttatttccgtattttcagctttgcgtttaggcaagttcaatattgacccacgccagagcagtagtttcatcggtatgcccactccggctaatgctttattttgggggtcattgactgtaggagcacattcttttcttatatccgattcttttaatgcggcatatcttttcatcttggtagttattatgtcattattgctggtggcagaaattccaatgttctcattaaaattcaagagtcttgcctggaaacagaacaaagtcagctatattttcctcattgtatgtattcccctgttggctttcttcaaaatcagcagttttgcagctatcatcctgtggtatatcattctatctcttttaactaaaaaaagagcgtaaacaataaacgtggcacgcttgttgtacgtggtatataaaaaaagaaattactatgtttggatttttaggctttctacttattatttttctgctgattgtttttatcggcttcactatattaggcaacattctgcgtgtattgttcgggatcggcaagcatcccccctaccagaatcgaacatctacccaccaaaaacaaaatacatatacccagactcaaacgaatgacgagaatgaaaactttgcagaattctcttcatcttcttcaaatagacattctcattcatcgggaaacagaaaaaaaatctttgatgacgatgagggagagtatgtagattatgaagaggtgaaataagaattatcgttttttcttaaagaaatctttcatcaatcgggcacattcatcggcgagtattcctttcaccacgatcgtctttggatgcaaggcatcgggggcatatttttgatatccccttttgggatcttcagcaccaaagacaagttttcctgtctgtgcccaggctatggcaccggcacacatcacacacggttccacagtgacatacaaagtacattcattcaggtatttcccgcccaaggtattagccgcagctgtgacagcctgcatttcggcatgagctgtaacatcattcaatgtttctgtcaaattatgcccacgaccaatgatgcggtcacgacagactaccaccgcccccaccggaacttctccttgttcagccgcttttacagcctccatcaaggcttgtttcatataataggtatcatctgccatcttatcttctcatatcatgttcattaaacaatgtaggataatcctcttccatcttctgatggataaaagtcaatactgtttcgcgtaaccaacgcgccttattggttatcttatactttttaagataacaatccacaatccgtacttcctcttcactcatcaaacataccatacgctgcttgcgtttaggggttgatgccggtacttttactctcttttttacgttgtttgccatattctctgcaaaattagctttacttctgtaaatacaaagcataaaaaagagtatttttgtacaaaaagaaacagaatggcagaacacaacgaatttggcaaagagggagaagaagaggccgctgcatatctcatagataaaggatattctatccgccaccggaactggcattgcggaaaaaaagaactggatattgtcgccgaatatcggaacgaactaattgttatagaggtaaagacccgcaagaatactagattcggtaatccggaagatgcagtaacagataagaagattcgcagaattatagcttcaactgatgcatacttgcgcaagttctcagtagatttacctgtacgttttgatatcatcaccttagtgggcgaaaagactcctttcactatagagcatattgaagaagccttttatcctccgatttggtaaaaatatatatattatatatggacatagaaacaatacgcgattactgtatcagaaagaaaggaacaacagaagaattcccttttgacaatgtcaccttagtattcaaagtcatggggaaaatgtatgcctgtatcggattggacaacccggaatggctatctttaaaatgtgcacccgaatatgccttggaattaagagaacatcattccggcattgaaggagcctatcacttcaataagaaatattggaaccaagtatccttacaaggtgacattgacgacaaacttattttatcactgatagaccactcatacgaagaggttatcaaaaaattcacccgtaaacttaaaaaagaatatgatgagatcccctaactggtcaagcaaaatcttaaaagaagaaaccgtaacctcaacaaatgaccgacttgcagaactttgccaggaaaaagaaatcaaggaattcaccacgcttatggcagaatatcaaaccgccggaaaagggcagcgtggaaattcatgggaatcagaatatggcaagaatctgacattcagcactgtattttacccccaaacaatcgctcccgccagtcagttcattttatctatggcggtagcttctgccatttgtaccgcattggcccattatgtccatgcagattgcctgcaaataaaatggcccaatgatatctattggaaagacaaaaaaatagccggcatattgattgaaaatgatttaacaggaagccaaatttcacagagcattattgggatagggatcaatattaaccaggaagaatttcattcatctgctcccaaccctgtttcattaagacaaattactcaaaaggaaacagacagaatggaagttctgaacagcgtattggaacatatcatagatctctattcccggatagaaaacagagaaaccgatatcattaccaaaattcaggaatactacctgaaagcacaataccgcaaggaaggttatcacccctattgcgatgcaaaaggagagtttactgccaaactgatccgtgtggagcccgacggacatttgattctgaaagataaaaacggttctcttagaaaatatgctttcaaagaagttaaatacctcctttagttgttcttctcttcaggaaccatcaacattcctccagtggcatgacgttctgtcgattgatacacagattcccccctcataatcggttgggataacgtattcatgcttctggctgaccggtttattcctgtgatcaaggagatggccttacccagcatgaattcatccggatcacccaatggtaataaagcgtctgtcggattctgagtcaaatcatactcattccattctatatccggtttaaaaccagcactgtagtcatcattcaccgcattagtcactctcaatgtgataggccaatatatccattcatatttatcattcttttgcatctccattcctacatttttcccttctgtcaattcgccaataaggataacatccataaatgggttgaggctgttaataacgacttccgaagaagaagccgtactttggcttgtcaatatataaattcgattggaattaagtttcaagtaacctgccgttcctttcgtttccacacaaaaatcattggaataggattgtcccttattgtcagagaaaacagcaaacaccttttttcgagaaacttctggaatgaggagtcctgcgagcatattagcagaattctcatatccacctccattatagcgcaagtccagcacaaattcattcacaccttgcgcctgaaatccggcgaatatcttcttcatttcctcatcataggtacgatccgaatatccattcggtccggaagtaaaatgattataaaccaaatacccaatcttcttatctccccgagtatatacattgtgatagaacaagggattgtcctccacggcccgggaagcttctatatcaatagttctgacctctgtatcgccacgtttgacgagccattgagtcctatctccatttaataagattccataattatcggaattaatattattttttcctttaacacccacgatccaatcccctctttccaaacctgcacttgatgccggactattaggaagaacatacagaatacgggcataataatatcctaaaggttgattactatcgtttacaacattaaataaagtaaactccataccataagtatcatccgcatcaatgctggtacgtgctttataatctttattcttctccatataagaataataataaagatgctttccgtttctcgtctttccatctttcaaactgagcatagatctaaagaatgtttggggatcagcagagaaatccaacttattttgagcaggaatgtcgttattccacaaataatcactgcgcatgacactctctatccactcattgacttccaactccgtgttaccatttcccgggtcatctcctttagccggagtatcatccgaacatgacatgcctaacagacataacaataagcccaaccaaatatggatttgaaaattctctttcataattctcctgttttgatcattttaataaccgcaaatatatctatattccaatgatatatcatcttaaacaacaactattttcaattcaaatttaaattttcattggttatttatgagaaagagagtacctttgtatccatctctatcaatctacactcatgattcaacttaataacggaaacaaaaaaatacttcaaatagccatcccttctatcgtttcaaacattacagttcctctgttgggcttgattgatgttactattgtaggtcatttgggctctgccgcctacatcggagcgatagctgtaggcggaatgcttttcaacatcatctactggattttcggttttctgcgtatgggaaccagcggcatgacttcgcaagcatacggcaggcacgacctgaatgaagtcacccggttactactccgttccgtcggagtaggattattcattgcatttactttgctagccttgcaatatcctatagaaagaaccgccttcacctttatccaaacgactgaagaagtagaacatctggcgtccctctatttctatatctgtatttggggagcaccggctgtattagggctttacagttttgccggctggtatatcggtatgcaaaattcccgtttccccatgtatatagccatcacacaaaatatagtgaacattgcggtcagtcttcttcttgtatatggattaggaatgaaaatagaaggtgtcgccatcggaacgttaactgcacaatatgccgggctagtcatggcatatttgttgtggttacgctactacagcaccctgcggaaacgcatagaatggcattccttctttgacaaacaggccatgtaccgtttcttccaagtaaacagggatatctttttccgtaccatctgcctggtggcggttactgtctttttcacctcggctggtgcggcacaaggagaagtggtgttggcggtcaatacattacttatgcaattattcactttattctcctacattatggacggcttcgcatacgccggagaagcattggcaggaagatatatcggagccaataatcagaaagcactccacacgacggttcgccaactattcggctggggagtaggattatcgcttgctttcaccttattatatagtatagggggacaatcctttctcggattactgactgacgaaacaactgtcattcatgcttccgaaagttatttttattgggtacttgccattcctttggcaggcttctctgcttttttgttcgatggaatattcatcggtgcgacagccacccatctgatgctgaaagccatgatagtagcctctgtcagtttctttcttatttactatggtttccggggggcaatgggcaatcacgctttatggatggcattcattacctatcttctacttcgcggagtaatgcaaggagtcatgggaagaaatattttaggatataaaacaagtaaaaaagattaatatttttatctttgcaaaaaactaaaagacaaaccaatatggcaagatttaaaagaattctactgaagctgagcggcgaaagcctgatgggcgaaaagcaatatggtatagacgaaaaacgtctgggtgaatatgcgcaacaaatcaaggaaatacacgaccttggcgtacaaataggtattgtaatcggtggtggaaacatcttccgggggctgagcggagcttccaaaggttttgaccgtgtaaaaggtgaccaaatggggatgttggcaaccgttatcaacagcttgggattgagttccgcattgggagcggccggagtcaaggcacgtgtattgacagctatccgcatggaacccatcggtgagttttacaacaaatggaaagcgattgaagcgatggaaaacggagaagttgtgattatgtctgccggaacaggcaatccgttttttactaccgataccgggtcttccctacgtggtatcgagatagaagccgatgtgatgttgaaaggaacacgcgtggacggcatttatacagctgatccggaaaaagaccccactgctacgaaatttgacgatatcacttacgatgaggtattgaagcgcggtttgaaagtaatggatcttacagcaacctgcatgtgcaaggaaaacaacctgcccattatcgttttcgacatggacacagtaggtaacctgaaaaaagtaatgaccggtgaaaatataggaacactggtacacaactgattttctcatcaagttcatccatttgtcattccttatttccttctaaatgacagatgggtgaacagtttttctctgtcttaccattttttccacaaattcgttctttattgacacatattccttaaaaaagagactcaaccgatagattttccatctaaatgaacaattattcatggacttatagcgttaattagcctatttttacatcagcaaaaaatgtaaatcattcaaagactataaaaacgacaggaaataccatgaaaaattactgttacatctgtttattgactgcctgcatggctcccatgtctctccaagcccaaaaagcaattccgtacagtggagaagtatgtgtagcccctctccctacagttcccacaacccttcccggcatatcttccgactcgtatgcccggcgctttgccgactctgagatgctccgctttcccaaagcttatcagctggatcatggcaaacggctctttttcgggtattcacaaggagtaggctgttgcgccatgctggatatgtggaaaaataccggtgacaaacgttactttacgtatgttgaggaatgggcggatagtttgattaacgaaaaaggagaaatccacctttatgatatgtcaacttacaacctggattacatcaattcaggaaaagtactgttcgacctctataaagaaacaggcaaagaaaaatacaaagcagccatggacttactggtagaacaactcaaaagacaaccacgtacgctggaaggtggcttctggcataaattgatctatcaacatcagatgtggctggacggactttatatggcttctcctttcctagcccgctatggagcggaattcaaccgtcctgatctgattaatgaagcggtaaaacaattcacactttgccacaaacatacctattcaccggaaaccggattatatcatcatgcctgggacgagagcaaatcccaacgttgggcaaatccgcaagacggtacttcacctaacttctggggacgcagtataggctggtggttcatggccatggtagatgtactggactatattcccgacaaccaccccggccgtgcctcgcttatcagttggattcaaggtttggcagaaagcctgcccaactatcaaagagacgggctatggtatcaggtaatagaccagcccgaacgtgaaggtaattttcccgaagcatccgtaaccacccaatgtatgtatgcttatgccaaagcggtgaacaaaggatatatagacgcccgataccggaccatcgcggaaaaagccttcaacggattaaagaaaacattgcttcgcgaaaaccccgacggaactctgacgctgacccgttgctgtcaagtaggcggactgggcggcactccttaccgcgacggaagctttgaatattacattggcgaaaagatgcgtgacaacgatgccaaagctaccggtcctttcatcatgggttgcctgcaacttggcaaatagaatcatatcgcataaacaacagaattatccatctttttaaattagctatatacaatgaaacacaccatttatgctctgacaatgtttgcattggccgcttgcacctctccccaagaggaagccatagaccgccatgcactggtaacacgcaataatccggaagtgaccgccatggactcattatcctccctgtcggtaggaaacggagaatttgcctacacggtagatgctacaggattgcagacttttcccgaagtctataaaaacggagttccactgggtacacaaagccaatggggatggcacagcttcggaaatcccgaaaactataaaccggaggaagccttggtggagtatgacttcagccacgggcacaaagagctatatgccacccaacccaaagaacccggcagagcaaaggaagcatccgactggtatcgtgtaaacccacaccgcctgcatctgggtatcatcggactcgaattagaaaatgaagtacgtccctcggatgtgcaaaacatacagcaatcactggatatgtggaacggtatcatcaacagccggttcaccctcaaagaaactccctaccacattcagacagtctgccatccggagcgtgacatgattgccgcacgcctgtcggcccgacaacctgccggcatcaagtttcacttcccctatcccacgggcggtcactgtgacgatgcttgtaattgggaggcgaatgataagcatagcacgaccctggtcagtgaagatgcacaatcggccgtgttaaaaagaacactcgacgcaaccacctattatgtaacaatcagttgggaaggcgctgcgaagctgagagaaaaaagtgcaaactatttcgtactcacgccaacggacagtgtatttacattcacctgccaattcacaccgcaagcgtccgctgctcccatcctgacttttgcggaagtacaacaagcctcttccggacactggcaaaattactggacacagggagctgttgccgacttctcacaatgtacggatgtccgtgccaaagaattggaacgccgggtcgtattaagccaatatctgctcgccatccaatgtgccggatcaaccccgccacaggaaaccggactgacttacaactcctggttcgggaaattccatttggaaatgatctggtggcatcaggcacaattcgccttatggggacatcccgaattactggaccgcactttatcctggtatgaaaccgtggaacccatagcccgccagatagcggaaagacaaggtttcaaaggcatacgatggatgaaaatgactgatcccagcggtacggaagccccctctaaagtaggcagcttcctgatctggcaacagcctcatctcatctacctggcagaattgctctatcgggctaatccatcggaagaactactgaaaaaatacaatagcctgatacaggaaaccgccgaattcatgtattcatttgccacatacgaggaagagcacgaccgttatgtcttgaaaggcgctattcccgcacaggaaacgttgcgcgccgccgaaactgtcaatccgccttttgaactttcgtactggcatttcgccatgcaagttgcccaaacatggcgtgaacgtacagggatggaacgtgtacccgaatgggatgtgctgatagagaaattatctccgctggcatacaacgacgaacagctgtatctggcagccgagaccgcggtggatacctataaagatatccgttttacctcagaccacatggcagtgctgggcgctgtcggcatcctgcccatgaatcagctgattcatgccggatatatgaaaaacaccctgcactggatttgggataactggaactgggacaagacctggggctgggattatccgatgacagccatgaatgccgcccgaatgggtgagcccgagaaggcagtcagcgcattattgatggacaaacgtaccaacacctatctggtaaacggtcacaattaccaggacgggcgtctgcgtatttacctgcccggcaacggtggattactgaccacagtcgccatgatgtgcgccggatgggacggatcggaaggaaacaatcccggatttccgaaagatggcaaatggaatgtacgctgggaagggttacagccgttaccgtaagaacaggagttagcagttattatcatgaaaacgacatatttacttctatgcctgttgggcatcggtagcgtttccggcgcaggacaaaccaaacagccacaaaagataggtgatttcatagaatccacttcgtacaacgaacatcgccggaatgccacccgaagcctgcaatatacccctgacggagacgattttgtctgcatcaacggtaagaatcgctttacccgtgccttatacggcagccacacagcattccggctggaaacaagcgaccggcccgtattcgctgcttataccaaggagaatccgaagcacatctgctttaaactgcaaacctccggaggcacggtagcccttgactctaccgaacactgcgagtcccgttatacagcgggacgccgcagctacagtttatctgatccggctttcggaggcggaagcttatccattaccacatgggcacttcccgataaagaaggggccatctggcaattcaacgcccggaatttcaaggaattccatcccgttctactggcatccatttcagagatacgtaattccaaactaaaccgtaacggagacatgggagccgacccagccgacagtttcgaagctcctctccagcctcaacagttacaatccttcccggtacagatagacggaacactttatatgctattggaaaaccaggaactacgcacactgacgactgccgaaggcgaaaacctgtttaaaaaggcagaagccgcccgctccgaaacagcctcacgcatccgcattgaaacacccgacccttatttcaacaccttaggaggcacgctggctatggctgccgatggaatctgggacggcgaagtgtggctacacggtgccataggctggcgaatgcccctcagtggctggcgagccgcctataccggcgatgttttgggatggcatgaccgtgcccggacccatttcaacgcatacgcggcaagtcaggtcaccgaagtgcccaacaccctcccccatccggcacaagattccgccctgcatctggcacgttccgtcaagaaatggggtacaccccaatacagtaacggatacatctgccgtaatccgcaccgcaataatcagatgcaccactacgacatgaacctttgctacatagacgaattgttatggcatttcaagtggacgggggacttggattatgtccgccaaatgtggcctgtcatcacccgtcacctcgcatgggaaaagctgaactacgacccggataacgacgggctgtatgacgcatacgcctgtatttgggccagtgacgccctttattacaatagcggagcagtcacccattcatcggcttataactaccgtgccaacaagacagcggcccaattggcagaaaagataggcgaggatcccactccttaccgcaacgaagccgaaaagattctgaaagccatgaacgagaggctatggcttcccgacaaaggacattgggcggaatatcaagattttatgggtcacaagcgagtacacgaaagtgccgctgtatggaccatttatcatgctatagacagcgaaacagccaatccgttccaagcctatcaggctacccgttatgtagacacagccattcctcatattcccgtcacagcccatggattaaaagagaatggctatgccactatcgccaccaccaactggctgccctactcatggagcatcaataatgtcgcctttgccgaagtgatgcataccgcattgtcatacttccaggccggacgtgccgacgccggatacaaacttttgaaaagctctgttctggacggcatgtatctaggagacagtccgggtaacttcggccagatcagcttctatgatgccgcacgcggagaatgctaccgcgatttcggtgatcccatcggagtcgcttcacgagtactgatccaaggtctgttcggtatcctgccggatgccctgaataaacaaatcatcctccggccgggcttcccggccgactgggacaaggcttccgtcagcactcccgatataagctatcgctttacccggaaagaagatacggatacctatcatatcacacaacggttccagactcctctccatccggtattgcacgtcaatgccagaaaagagaagatccgttcagtaaaagtgaacggtgtccctgccacatggcaatccatcgaatcggcccatggctatcctcttctttcaatccaggcggaaggaacatcttcaaccaccattaccatcgaatgggaaggagcaccacttcacacgttggcagtccaggaaccagtcatcacttcaaacgggaagttggctttgcaaataccttcgggagcatccatctcccaagtatatgatcctcagagcgttttagcaaatcacactgtagaagccaccgctttcaacgcacagataaaaggtgaaccgggacaccacactttctttgtttacactcatcaaggagaaatggattggtggcaacctgttaatatctatatagagaacacccggaaagccccctcctatacagactttgcagatatccgtcccgaaaaatgccggatggttgattttgacagacaactgaatgcttccgtcaccgatatttatcaaaatgaatacctgtctccccggtctccatacactacgttgcaacttcccacacagggaataggagaatggtgtcatccgctgctgaccgctaccatagacgactcggaattacgcagtcttgtacatcatgatactttccaaacgtctttaggcatccccttccgtctgaaagaaaaaggaaacaacattcttttcacctccctatgggataattacccggacagttccaccatctcactatccggcactgcctcacatgcttatctgctgatggcgggaagtaccaaccacatgcagtgccacattgccaatggaataatacgcatacactatgcagacggaacttcccaagcaacggagttgaccaatccggacaactggtgtcctatagaacaagatttctatgtggacggcaaagcattccaagtacctgctccccggccgtaccgtctgcacttgaaaagcggtaaagtaagccgtgacctgggtaaggaactcaacatcaccggtgtatatggacgtgagatagagggtggtgcaggcatattgctcgatattcctttggatgattccaaggaactaaaagggctgaccctggaaaccctgtccaatgatgtggtgataggaataatgggaatcactttgcaataaccacgtgttattcaatgcggaattacgttaacttgaaccggcgtagttccgcattattcatctttggcacactacgcaaatgttccaaagtcactccttgaatgtgtgcctgtaccgccctgtttatcagtccatgcccgacggccaacacctgttttccatcatatcgctctttcaagtagtccacaaaacgccccgcacgttcatagagcatcgcctccgtttccacatctgccggaaaatgttgcaaatcaacttctttaatggcaagacctgtccaactcccccaatcgatttcacgcagcaagactgttttctcccaaggcaggttccgaccttccaccgcgatacgggccgtatccacacaccgtttcaaatcactactgaccactgcatccaaagagatgttccgcaaagtatcacacagcgcttcagcctgtgctattccttcaacagtcagcgtgcccggcatatgtccttggaaaatacgggcgatattctcttctgtctgcccgtgacgggctaaatataaagttatcatcttttttaatgcaaagataatgcttaccggccagatttacttcaaaagggcaaccttcttattctcctttccaaagaaaagcaatcttcagacagatgataaaaaaataacaatcttgcctataaaagtattctccccgtagattaaggggtttcttccgtacagttaaggcctttcatgcggtaacctactacagactccgtcagtagactgtacagtctgttacatcagaccgtacggtccactacaatagtttatacagtccattatcggagtctgtagtaggttaccgtatgaaaaagcttaatcatgcagtagaaaagacttagtatacaggggaaaaaggcttaagtattcatcaaaagcagacagccaccttcgaaatgtcactccgcctgcaagctacaaattatccaccgtatcttccacttctatcacccagtccccgatagtacgggtggcactgtcgaaattaatccccaccttcacgatgcgcctgccatccttgcgataaggaacagcatacagcctgctgtttatctgcgccaatgcctcccgggccgtaccgtcatatttaaattccagcacataaatggcatcctgcatctttatgaccacatccgcacgccccaccgcacttttcacctcgctgtccacatacatccccatcagacggaacaacaaataaaagatggtctggtaatgcttctccgtcttgttctccaaatcattgggaatggaagcaaagaaagaacgcgtacgttccaagcagctctctatatctcccttacgaagatcgcgaatgaaggaaacgacataaaaagtactgctctgacccggcaactcaaggtaagcgggcaacagggactcgatgaaacctttacgcacctccccgttgggataggccagccggtacacctggaactcgggatcatatcccttgatcgtcaggtaaccactttgatataaaacggggataggactggttacacgttccgtcggggcatcaaactgctcgtctgtagcctccaccccctccagctggcgcacgtcaaaatccgtttcctgcaacaaatcaatcaagaaagtaggagtaccggtagagaaccagaaattcttgtactcctttgcatcaaaggcattgaacagactgaaaggattgtaaatttcctcacaatgcttgctgaaatgatacccgtcatactgcctcttcagatgcgcacaggcagcttcatacgtctcgccgttcgccaaagccatccgctcaatgtccggacgaagctcgtccagcaactcccgctcggtgatgccgcatatcgcgctgaagtcatcccgcatactgatgttcttcaaattattcagctcactgaagatgctcatctggctgaacttgctgattcccgtgataaagaggaaacgaaggtattgccccaatcccttgagaggactgaaaaacttacgcagttcattccgaagctcctgctgcaaggggatgttggaattactgtccaaaagaggagcgtcgtattcgtcaatcaggacaacgaccggcagaccggtctgttcatacgcacggcggatcataccttgcagacgagctgcaggagtcttttcctccttttccgccccataaaccttttcacaacgaagtaaaaacagattcaactgttcctgcaaatcgaacagggtagtatatttagtcagactgaaatcaatatggaataccggatacacgttccagtccttttccagacgctccatggccagccccttaaacaaatcttttttcccttgaaagtaagcctcaagagtggacaccaacaagcttttcccaaacctccgcggacggctcagaaaatacacactgtccgtgttagccaatcggtaaaccagttcagtcttgtctacatatacacaattccggttacgcaactgctcaaaattctgtatacctatggggtatcgtctgtaattttcttccatattctcattgttttctaattctgcttatgggatagaaacaaagatagctgttatccgataaaacacaaaaacttttcatttgtttttaataaagccccaacaacttaaactggtgatgataaggtaaagagccgttagaaatataaaatcatctctcttttattgcagataatcaaaaaataaattacttttgtttcacttaaaacgaatcaataaacaacttaaataacagaacagtatgatagacgcaaaaacttgcatcaacgacgcacaagagaaaatggacatggccgttatgtatttggaagaagccttagcgcacattcgtgcaggaaaagccagtacccggttgctggacggcattcgtgttgactcttatggaagcatggttcccatcagtaatgtagctgccgtgactactcccgatgcacgcagtatcgccatcaagccatgggacaaaagtatgttccgtatcatcgaaaaagctatcatggactctgatctgggcatcactcccgaaaacaacggtgaaattatccgtttgggtattccgccattgacagaggaacgccgcaagcaactggccaaacaatgtaaaggcgaaggcgaaaccgcaaaagtaagtatacgcaacgcacgccgtgacgctatagacacactgaaaaaggccgttaaagagggtatgcccgaagacgagcaaaagaatgcggaagccaaacttcagaaagtacacgataaatatatcgcgaagattgaagaacttctagcagagaaagataaagaaattatgacggtttaatgaagaacttaaaataatgaagcaataataatgaagaaggaagaattgtcctgcacagccttgcttttgtccgtgcgatccaattcctctttcttcatttttcattcttcattttaatttatgaaaggactagtaataaaaaacacaggcagctggtatcttgtcaaaacagaagacggacgtaccatcgaatgcaagatcaaaggaaatttccgtttaaagggtattcggagtaccaatcccattgctgtaggagattatgtacaaatcattatcaacaatgaaggaaccgccttcatcagtgagatagaagaccgcaagaactatatcatccggcgcgcctccaacctttccaaacaatcgcacatactggctgccaatctggatcaatgtatgctgattgttacaattaattatcccgaaacctcaactatattcattgaccgttttctagccaccgcggaagcataccgtgtacccgtcaaactgatattcaataagacagacaggtataatgaggatgatacacgctatatggatgctctgataaacctgtacacatacatcggttacccttgcttcaaagtttccgcactgaacaacataggtacagatgaagtgaaaaaagacctggaagggaaggtcactttgctttccggcaactcaggagtagggaaatcaacattaatcaacgccattttacctgaacaaactttgaaaacaggtgaaatatccgattaccataacaagggaatgcataccacaaccttttccgaaatgttcccggtagacggcggcggatacatcatcgacactccgggtatcaaaggtttcggaacattcgatatggaagaagaggaagtaggacattactttaaagaaatatttgaatattccgctcattgcaagtatggaaactgcacccataggcacgagcccggatgcgccgtacgcgatgcagtggagaaacatctaatcagcgagtcacgctatacttcttacctgaatatgttggaagacaaggaagaaggcaagtatcgcgccgcttactaaaaaccacaactttatgaaaaaacacctcttagctattgcactgtttgcattatgcaccaccgggctgaatgccgcttctcctaaaaaagtagctcctgaaaaaaaaggagtagaaaccattaaccgtgccacagccgaagcacatatcggctttttggcctgtgacgaactggaaggacgcgaagccggatggaaaggtggacgcattgcaggcaattatatcatttcctgcctgaaacagatgggaataaagccactggacggagactatatacagccctttgacgtgtatcatgctgaacggcaagtgaaagggaaacgctggcaagtacatcccgattctattgcggaactgaaaaaagtggtacatcaaaaattggcattacgtaatatcttaggtaaaatagaaggaaagaatccaaatgaaattgtcattatcggtgcacattacgaccacataggctacgatccgatgctggaaggagatcagatttataacggtgcagatgataatgcatcaggcgttcaagccgtattacaggtagcccgtgcttttcttgctaccggcgagcagccggaacgtaccgttatcttcgccttttgggatggtgaggaaaagggattgctgggctcccgttatttcgccatgaactatccggatattaaaaaggtaaaaggctatttgaactatgacatgataggacgtaacagccgggaggaccagcccgattatttcgtttacttctataccgcagcccatcaggccttcggtgactggctgaaaaaagatattgaggattaccgcttgcagttatcccctgactaccgggcttgggacaatccggtgggaggcagcgacaacggcacgttcgccaaacagggaatacctattatatggtatcacactgatgcccatcccgattatcaccttccgggagatgaaacacagaaaatcaattggctgaagatagtcgatataaccaaagcctctttccttgcgatgtggaaactggcaaacgaaaaaaaatattaaaaaagaacgtggcgtttaaactgaacgccacgtttttttatctaatcttacattaacgtatttattaaacccatatagaaaggcacatgaacaaacgaatcaaatggggcatcattatattaatcggagccggcttggccggactaggcatctatcaatttacccctcacgaaaataaagaactgacagccgccgacgcgttgcctaaagaaaacaagcaacgcacattgaaagtcaatgcacaagtcataaaaccacacttgctgacagatgaaatattggtgaccggacgtctggttcctgacgaagaagtgagtttgtcttttgaaacctccggaaagatcaccgatatttttttcacagaaggcacattggtaaaacgaggagaattacttgccaaagtaaacgaccggcagttacaggctcagttaaaacgtctggaagcacaaatacctttagccgaagaccgtgtgttccgccaaaacgccctgttaaaacgagatgcggtcagtaaagaagcatacgaacaggtaaaaaccgaacttgccacccttaacgctgatatcgaaaatatcaaagccaacattgacatgaccgaactccgcgcaccattcgacggtatcatcggattgaggcaggtcagtacgggagcatacgcctcccccaccaccgtagtagccagactgaccaaagtgactccattgaaagtagagttcgctgtaccggaacgttatgcccgggaaattaaaaaagggactaacctggagttcaaagtagaaggaaggctggatacctatcatgcacaggtttatgcaaccgaatccagtatagatatggaaacccattcattgaacatccgtgccatctaccccaaccgcaacggcgaactgttggcaggcagatatgcagatattcaattaaaacaaaaagaaatagaagatgcgatagcgattccatccgaagcgattgtccccgaaatgggtaaaaataaagtatttgtttatcgtagcggagttgcagaccctgtagatgttattataggactccgtaccgaagccgaagtacagattgtacgaggattgtctgtgggtgataccatcctgacatcgggtacactgcaattacgtaagggaatgcctgtggaacttcaggccattaactaacaactaaaaaaatacttttatgaatatttccgaacttagtatccgtaggcctgtgctcgccaccgtgcttaccatcatcatattacttttcggactgatcggttacaatacattgggagtccgcgaatatccttcggtagataatccgatcatctctgttacctgtagttactcgggtgccaatgccgatgtaatcgagaatcagataaccgagcctttggaacaaaacatcaacggtattccgggaatccgttctttgtccagtgtcagccaacaagggcaatgccgtatcacagtggaatttgaattatccgtcgatttggaaactgccgccaatgacgtacgtgacaaagtgtcccgcgcacaacgttacctgccacgcgactgtgaccctcctactgtatccaaggctgatgccgatgcaacgcctatcctgatggtagctatccaaagtgacagccgctctctgttggaactgagtgaaatagcagacttgaccgtaaaagaacaactgcaaaccatttcggatgtaagcagcgtatctatttggggagaaaaacgttactccatgcgcctatggctcgaccccaccaagatggcagggtatggcattactccggtagatgtaaagaacgcgataaccaatgaaaatatagaactcccctcgggcagcattgaaggtaataccgtagaattgaccttacgcaccatgggacaaatgcacaccgctaaagaattcaataacatcatattaaaagaagtaggcggaagagtggtccgtttcagcgatatcggttacgccgaactaggtccggcagatatcaagagttacatgaaaatgaacggagtgccgatggtaggtgtcgttgtcattccacaacccggtgccaaccatatcgaaatcgccgatgccgtataccagcgtatggagcagatgaagaaggacttgcccgacgatgtgaaatacagctatggctttgacaacactaagtttatccgcgcttccattgatgaagtaaaaagtacggtgtatgaagcgttcgtactggttatcatcatcattttcctgttcttgcgcgactggcgcgtgacactgattccctgcatcgtgattccggtttcattgatcggagctttctttgtgatgtacatagcaggtttctccatcaatgtgctgaccatgctggcggtggtattgtccgtaggtttggtagtggatgacgccatcgttatgacagaaaatatctatatccgcatagaacgaggtatgcgtccgttcgaagcaggaatagaaggggcaaaagaaattttcttcgctgttatctccaccactatcaccttggtggcagtgttcctgcccatcgtatttatggaaggaaccagcggacgtctgttccgtgagttcagtttcgttgtggcaggttcggtcatcatttcttcctttgccgcattaacgttcacccctatgctggcaaccaagctattgataaaacgggaaaaacagggatggttctaccaaaagacagagcctttctttgaaggtatgaaccgcatatatgcccgttcactgaacgcttttcttaaaagacgcatatgggcaatacctgttacagtgattatgttgatagccatcggagtactttgggtccagatacccgctgaaatggctcccatggaagaccggtcgcaaataagtatcaatacccgtgcagccgaaggggccagctatgaatacatccgtgattatacggaagatatcaacaatctggtagattctattatacctgatgccgaatctgtaaccgcacgtgtttccagtggcagtggaaatatacgtatcacattgaaagatatcaaagatcgtgattacacccagatggaagttgccgaacgtatctcacaggccatccgcaacaagacgaaagcacgtgcctttgtgcaacaacagtcttctttcggcggacggagaggaagtatgcccgtacaatatgtactacaagctgtcagtatagaaaaactggagaaagtattaccggcttttttaagcaaagtatatgataaccctactttccagatggcggacgtggacctgaagttcagcagcccggaaatgagagtgaatattaaccgtgataaggcaggtacaatgggagccaccgtgcgtgatatagccgaaacactgcaatacggtctcagcggacaacgtatgggctatttttatatgaatggaaaacaatatgagattttgggtcagataaaccgccaacaacgtaatacaccggccaatatcaaatctatttacatacgaagcgacaaaggggaaatgattcaattggacaatctggtagaatttgtagaatccgtagctcctcctaaattgtaccactacaaccgttttatttccgctaccgtatctgccggactggcagatggaaagaccatcggacaaggcttggaagaaatggataaaatcgccgcccagactttggacgaaactttccgtaccgccttgtcgggagactccaaagactatcgggaaagttcatccagcctgatgtttgctttcattctggcattgatacttatctatcttattctggcggcacagttcgaaagtttcaaggaccctttcatcatcatgcttaccgttcctctggccattgcaggagcactgattttcatgtatgccggtggcattaccatgaacatattcagccagatcggtattattatgctgattggtctggtagcaaagaatggtatcttgattgtggaatttgccaatcagaaacaagaatccggtgaaaacaagatgcaggccatacgggatgctgctttgcaacgcttgcgccctattctcatgacaagtgcctctaccgtattaggcttgatcccgctggcattcgcaacaggagaaggcgccaaccaacgtattgccatgggtacggctgttgtgggaggaatgttagtatctactttcctgaccatgtatatcgtaccggctatttatagttatatatctaccaaccgaaacgttaaaacagaaactgtatgaaacgaatcattataactttatggatctgtactgcatgggtggcttccacctatgcgcaatatccttatacgctgaaaaaatgtctggaggaaggacttgcaaacaattattccatacgtatcacccgtaatgaagaacagatcagccataacaatgccacattagcaaatgccggttatctgccgactgttgatttgtctgccggatatacaggaacgttggacaatacggataccaagagtagaagtacaggcactacagccagtgaacgaaacatctacgaccaaaccttaaaggccggactggatgtaaactggactctgttcgacggattcaatatcagcaccacctacaaaaaactgaaggaactggaacgccagggagaaaccaacacgcgtattacccttgaagacttcatagcgggactcactgccgaatactataattatgtacaacaggaaatacgtctgaagaacttcctttacgctgtgtctttatccaaagaacgcctgcgcattgtagaagaacgataccatatcggtaatttttcccggctggattatcaacaagccaaagtggacttcaatgcagacagtgcacaatatatgaaacaacaggaactggtggttacctcacgtatcaacctgaacgagttaatggccgtacaggaagtcaaccgaccgctacgtgtcaatgactccattataacagtgaatgatgcgctgaattacgatgaattatgggaatccaccctcaagacgaatgccaacctgctgaaagctgatcaaaatacaacaattgcccaattggattaccgtcaggttctatcccgtaattatccctatgtaaaattgaacgccggttatggctatacattcaacaaatatgaaacaaacgccaccagccggagaagcaattggggactaaacggaggaattaccgtaggcattaacctatgggatggtaaccgtcgccgtgaaaagcgcaatgccagcctgcaaatacgtaactcgcaactggaaagagaacagctggaattgggcttgaaagcggatttaagcaatctgtggcaggcctatcgcaataatttacgtttattaaatttggaacgccagaatctggttgccgcccgtgaaaaccatgaaatagccaaagaacgttatctgttgggagatctctccggtatcgagatgcgtgaagcccaaaagagcctgcttgatgcggaagaacgtattttgtctgctgaatataacaccaaagtctgtgaaatttccctgctccaactaagtggaagaataacgaaatatctcgaataatcgttatagcctttacttatagcttgtaattcagggcagttatccgtacctttgcacacaattatcactaaatatgttgtaaaaagatatgggattatttatcaagaagccttttgctgcattacaagccgaagccaatgaatctggaaacaagaccctgaaaagagtcttgggaccatggagcttgatcgcattaggagtaggtgttatcatcggtgccggattattctccatcaccggaacagtagccgcaggatacacagggcctgccattactttatcttttgccatagcggcaataggttgttgctttgccggtttatgttatgccgagtttgcttccatgatacctgtagcaggcagtgcttatacatactcatatgctacaatgggcgaacttatagcatggattatcggctgggatctagtattggaatatactgttgccgctactaccgtcagtatcagctggagcagatatctcgttgtttttctggaaggagtggggataaatatcccccatgcacttgctgcttgtccctgggacggaggtattgtgaatataccagccgcactgattgtagtgctgatgagtatttttctgattcgtggaacagaaggaagttctatctttaacggcttcattgtgttcctgaaagtggcagtgattcttattttcgttgtattaggatggaaatacattaatgcagagaattatgttccttatatccctgccaatactggtactttaggcgagttcggattctcgggtgtattgcgtggagcagcgattgtatttttcgcctttcttggttttgatgccgtaagtacagccgctcaggaaacaaaaaatccgaaacgggatatgcccgtcggcattctaggttccctgctgatttgcaccattctttatatggtgtttgcttacgtaatgacgggagttgcccattattctgactttgcaggacaacaaggtatcgcacctgttgccgtagcgattgaccacatgggacatgcagatgccacaggagtaattcatccggattatccgtggttgaaccgggccatcgtactggctatcctgtttggttactgctcggttattatggtaactttgctaggacaaagccgtgtatttctaagtatgagccgcgacggactgttgccttctttcttttcaaagattcacgagaaataccggacaccggcacacagtaatttgttattcatggtcattgtaggagggctggcagcatttgttccggcacgtgtagccggagaaatgaccagtataggtaccttatttgccttcacattggtttgcgcggcagtattgatcgtgcgtaaaagtatgcctgacgtacatcgtgcctttaaaactccttttgttcccacggtaccgattctgggcatccttacctgcctttgtatgatgttgtttcttccggctgacacttggatccgattggtattatggatgctgataggtctggatgtttatgcctgctatggagtaaaacacagcaagctggagcataacgtaaaacgacgcaaaggactcaccatattgaatatgacaggaatcgccctgtctgtactttcagttattacaggattgtggcatcaacagacagtaggctgggaagaagacaagacattgctcgctatttcgttcgtctttgcgttcacacattgcgcattctatatggtacgtatctggaaacagacatccgagaagaagaagtaagcgttttccacacgctatctgtttccataactttcattcaccgtaaggggtaaattcaatccaccccctaccgtgaataaagttatcatagtttcatacccatcggttctgaacccataatcaagccttataacctatgaaagtcttaagttatccatagtagaaagaacatttaaaaaacttcttcaaaaatgtttttagctactaccacagtatttccttcaggaattgaggaatagaatcctgtttctttagtccatgcttcttccaaggtataaaaatcaagttcctccggttgctttccatccaggacacaagctaaataatcaaaataagccttccatctcataaaatagaaatctttcaaaatgccattccactctttatgagcataatcacgaagtccgccttgatctgccgctacacgatttccccatgtagtaatctgaacacgtgcattccattcgtataatgctttttcttcctgggtctgtcctgctgaacgtgccgcttcaatccaagttccaaccttgaattctttccgggtacccagcaactggtcttgcaatagaataagatgcagaaaatgctgtgaagccaactcaaatacttgcttgtctcctgcccggaacgcagccgttaccactttttgcatcaaacgccccttttctgccaatgcctgccggagcacatccaccaaatcgaactcaaaattattattaccctgatatttatcagccacagaaaccatcagtcgggcagcctctatcacatcctgcggattatagtattctttcatctccgaccaactggatacctgatatacatccaaccccggacgagcgcagaatacagattcatgcgttccctgttgtatcttctccttgggactattataaataccgttacctaataaatcccaagcttgttgcaaagcctcatcctctaccccataacgagcatatacgtatcctttcaaccactcatcacgagtaaaccgatgttcacgccatggcaattccatcaccagctcatacataaccggattgttctcaataccttccggagtcatccctactccacgcaatgtccttccggcatgaacatctgctttcgcgtcataaaagccatcaatcagcgcatccattttaccatgaagcccaatgttaccaccaaaattcaacaacatacagtacacccactcatgctgcccgtatcctcctttgcgacaccactctgacgccgggtccccccattgcggacggcattcgctatgcaagtccaagactaacaggtctcctgcttccagatgctctatcatcggagtacgaggattgtcctgccatgcctgagccacccacacagcatccggatttgtttttttcatggctttcatgatggctttaccggctgcatccaaatttactccttgagtacttcccccttcatgaaacggatcaatagcgtaaaaacctgtttttccatacagttttgtcagttctctataatacaaagcagagatttcttcaaagcgttcatcctccggctgtaaaaaggcaggacgatgatagctgcaccaaaatccgggatcagcaacattcaatcctaatttctcctttgcattatgaggaaccatgccacaatatcccggcaacacaggttcgatgccatattcacgcattctttttacaatcttcttctgaagtttttcctgacgggtataccaactttcaggattaggtcctccccacccttccagattattcatcaaccaccaagctgtaaaacccggtccggctacaaattcattaatttcatccttagtatatcccagttttagaagtacatttctccaaaccgactcagttcctgtcaatgccagggaaagattgataccgtgaagcgccatccaatctatctccttttcccaacgctcccagtcccaaaaagccatggaataagagaaagtacaataattcagatcataacgatagggcagatccgtttcatgccgttcctttttagtcacagggggcaaaacagcaggcagttttgcagtcattccattccaagaaagatgtatgcctgcataatatttcaaataccaattcaatccggtagcaatatttacatagtcattaccccggataattactttatcacctttctgatcgagttcaaaaaaatcagtttccgatttctgacgttcaataataaatttggaggaagctcctttgtcgatgcgctctaataatcctgtaacaggagaagaaaataagttgcttgtcatccataacagcacaaacaacaatcgtagttttttcatcatattattaaggtaacggataacaccaattaaataaaaaacagaacagccccctcgcctttaaagggaggaaggctgtattagtattattacggaataatttaattatttacaatttccaaggcaacgcggcttcaactgcttgaagaagtcattacctttatcgtccaccaaaatgaatgccggaaaatcttccacttcaattttccagatagcttccatacccaattccggatattccacacactcaatgctcttgatattattctgagcaaggatagcagccggaccaccaatagagcccagatagaaaccgccatacttcttacaagcatccgttacctgctggctacgattaccttttgccaacattatcatgctaccgccatgtgactggaacaaatccacatacgggtccatacgtcctgctgtagtggggcccatagaaccacaagccataccttccggagtctttgccggaccggcataatagataggatgatctttgatatactgcggcaaatcttcgccacgatccaaacgctctttcaatttagcatgagcgatatcgcgacctacaataatggttccgttcaatgacagacgggtagctaccggatacttggtcaattctttcaggatatccgccatcggttggttcaaatcaatcttaaccacatcgccttcaccggcttcacggagttctgccggaatcagctcacccggtttatcatccatcttttcaatccagataccatctttattgatcttacattttatattacggtcagcagaacaggaaacgcccagaccgataggacaagaagcaccgtgacgaggcaagcggatgatgcggacatcgtgagccatatacttaccaccaaactgtgcacccaagccaatcttataagcttcttccaatacttgtttttccagttccacatcgcggaaagcacgcccgtattcattaccggtagtaggcaactcgtcataatagtgagtagaagccagcttaacagtcagcaagttcttctctgccgatgtaccaccgattacaaatgcaatatgataaggaggacaagcagccgtacccaaagtcttcattttttcaacaaggaaaggaaccaatgtagccggattcaatacagctttcgtttcctgatataaataggtcttgttcgccgaaccaccacctttagtcacacaaaggaacttgtattccataccttcagtagcttccaaatcaatttgtgcaggcaggttacatttggtgttcacctcatcgtacatagtcaaaggagcattctgagaataacgaagattttcttccgtataagtcttataaactcccaaggaaagggcttcttcatcacaatagccggtccatacctgctgacctttctcaccatggataatagcagtacccgtatcttgacaaagaggtaatttgcctttagctgaaacttccgcattacgcaagaaagtcaatgctacatacttatcgttatcactggcttcgggatcactcagaatcttagcaacctgttcattgtgtgaacggcgaagcaagaaagaaacatcacggaaagcagcgttagccatagcagtcagaccttctttttcaatcttcaagataggttttccttcaaactcacttactgacacataatctttagtcagcaaataatactcggttttatcaggtcccaacgggaacatgtgctgataatggaacggaggtgttgccatattgatacttattttagttaaaagttattagtgtgacaaaggtagtaactattatcgaaatttttccttaattagcgtgaaaactttcaaggaatgtacttacctttgccaactcattaaaataacatcacattatacatgaaaagattaggcaaattcttatttattacttcattactgttatgctttctcatccctcgaggatggacacaaacccaagcaaaaaaccaaccggacagtatcgaactcaaactgaaggaaatctacacgaaacgggaagtcatgattcccatgcgtgacggaatcaagctttacaccgctgtctatgaaccgaaagacaacagcaggcagcatcctatcctgatgcaccgcagcccttactcttgttccccatacggagaaggatttgaccgtcatttcagaactaatctgaaaaactatatagagcaccgatatattatcgtcttccaagatgtacgtggacggcataagagtgaaggaatatttatccaagtacgccctctcaacaaaaacaaaaagggtaagaaagataaaaagaatatagacgaagctacggacacatacgataccatagaatggttgattcacaacacatataataacggaaatgtaggaacatggggaatcagttatgatggtttctatgccactatgacagcctcctccaatcatccggctttgaaagctgtttctccgcaagctcccgttactgactggttccgtggagatgaccgtcatcacaacggagccttcaccctgctgcaaaccactaatttccttcccagactggaaggacgccacatgggaaaaggagtgatgaaccaaattgtaaagaatgatgtttacacagattttctggcactcggtacctttaagaatgtagacgacctggtacgtgataccacacagacattgtggaatgatatcaaaaaccatcctgatttcgatgatttctggaaagagcgcgatgcacgcacctcctgttataacttgaagcccgccatattggtggtaggtggactgtatgactccgaagactgttacggagcctggaatctttataaagccatcaaagagcaatcaccggacacagatttatatctgacattcggtccttggtggcatggagcatggacagtacgcgggttccaaggtttcggtaatctgtatttcggtaaaagcacttcggcttattacatggacaaaatagaatatccttttttccgatatttcctggaaggaaagggagaaaagcccaagcataaagtaaatatattccatacaggtgaaaacgaatggaaaacatacgacgaatggcctgtacaaaagactgccggtacaccttattatatacataaaaacggatcagtatccacacaagcaccggcagaacaagagtcttattcagaatatatttcagatatgtcacgtccggtaccctatacggcaaaccctaccacttaccggacaaaagaattcatggtagatgaccaacgctttgctacttcacgtcccgatgtcattactttcatgacggagccgctatgtgatactttaacattggccggtcctatagaagtggaattaatgactgccatcagtagtactgacgctgattttatggtgaaagtaattgatgtatatcctgaaaaatttgaatattccaaaactgcacgcagttatttaaagagtgactacccaatgagtgggtaccagctgatgattcgtggcgaattattcagaggacgcttccgtaagggattcgacaatcccctgcctttcaaaccggaagaaataactccggttaattacacactgtatgatgtggcacacacattcctgccgggacacagactgatgattcaaattcaaagttcctggttccccattattgaccgcaatccacaaaggtttattgatacctatcattgtacggtagaagattttgtgatgaaacaaaagatcaaaatttatcatcagcaaggagctgcaagcagagttatactacctgtggtaaaaaaataaaaaggaagtatcccaacaagctcaaatgtcatccaatagcaagagccgtatgactactccagcattcatacggctctttttatatgtaactaccatctgtaacttttccgaaggttcatcttagtctggatactctcatcaaaaatatcatatagaagcaatccgttctatcaactcgttacccaacgctgttttcgcttcaatatgctgcaataccgctgtcacaaacggattactttcaaatacaccacgcacctgttcaaaatcctgctccatttcttcacgtgatccatctgcaccgaaccccgtcatagcagacaaagaaaattcctttttcgcatcggcatagaccattttatccaatccgacaacagcctcctgccacttcttcacgatagcaataacattctttgccgttatttcatcggaacgcagattataaaactcaagcatcttcccatacgcccatgtccactcgtatgtataataattacgatgcatctcaacaaaacggtcatgaatctgatccacattagtcaggattccagattctatatctgccatcaacttctctatttcacttttaggagcgatcaatccggaaatatccacccattctcctgtccctatctctgtatcaggaatcaaccgggcacggatttcctcatcactgctaaaacgaacctcctccaaacgcttgattaatgaattacccaaaaatttatgaatagccgtttcataaaaacgaatgccattatttaaagaagaattcttaattttcgcactttggtaagagtaagtttctgaagtttctccggatactttacgtaattctttcagaatactacgccctttcatcattttctgaatagtatagggactcaacaggttataattaatctgatccaaacggttcggatctttacgtttgtcacgtttaggccacttttgagcatcccgaatcgtacctacactccgcaaattcacccctggcaccagataagtggtattttgctgctctatcagataagaaaaaggcagattagaagtatcggcatgattcacatgacgccccataaccaaagaaaatgcacctacacgtgcgggccataaaatataagaatcggaagtagtcttcgccccacgctccatagccccctgatgaatcggacctaacttatacatatggttgctttgattagagccggaacccgcattcataaaagagaacattccggcaatcagcaaagtagacttatgatgagtcaccgtaaagggtccggcaaaaatggcacatgcctcaccgttctcttcttgacaattactgaaaaacaaagaatcagatgcagaatagttatgtcccaaatgacatgcctggctgataaagcaacgggtcaacatagttccatcttccacattggagccgcttgatataataaaatcatcgcataccactccatagccgatatgaataggcgcttgctcattactgttcaagctaccgtttttcaatcgtcccgccccttctatcttacaataatcacctattcgtacattctttatatatcccgcatcaacaatggtaacatggtggccaatagtacctgtatccgaagcattctcttcagcataccggtcaataatggctttcatccggcaaatcaattcaggacgatgacggtacaatgccagaatataggcctgatgcgctgacagacgatcatgaataggcacttcacgtccacccgtttcattcaatacagctacttcaacgccattcccaaacttgctccggccatctaccagaatgatatctacattctctataaatgcataatccccaatgatatagttggctatatagttctttatattctcaatacaacaattatcgcccaccgttacattatgcaaggtcgcatgatacaatccggaatgtttacgcatgccacctgccaacgtaaactcatcctcaaagacccccaatctgacctttccggaaaaacgggtatgataaatatagtccgtcttaaagttctctactacttcaatttcatcccaatcaaccgcagtgcatgatctctcttttaattgttgtatttcttcttgtgtaagtgaacgataagttttcatcttctatatgtatttattcttcatcataggtttgataaagaaaatcgttataaggatacttctgtacgtgtagctcgcgcaccttattatatataatagtcttcaattcatccatatttattttctctctggcagaaatgaagatacaattatcattcaattttgccatccatgtcttcatcagttcttccaatgtaatattctccctggttttaggagtcaaatcatcctctgctttctctatataggtataagcatctatcttgttaaaaacaatcatggtaggctttccacctgcccccaaatcagcaatcgttttatcaaccacagaaatttgttcctcaaaatccggatgagaaatatccaccacatgaatcagtagatcagcttcacgcacttcgtccaaagttgatttaaaggaatcaaccaaatccgttggtaatttacggataaatcctacggtatctgtaagcagaaatggcagattctcaataatcactttgcgtactgtggtgtccaatgttgcaaaaagtttattttcagcaaagacctcgctttttgaaagcaaattcattaaagtagattttcccacattggtataccctaccaaagctacacgtatcatacgcccacggtttttacgttgagtggacttctgtttatcaatttcagccaaccgttctttcaacaatgacatacgattcaaaatgatacgacggtccatttccaactgagtttcacccggcccacgtaatcccacagagcctttacctccaccggcaccggatccacctccctgacgctccaagtgagtccacaaacgttgcagacgaggcagcatatacttatattgggccagctccacttgtgttttagcatttgcagtttgagcccgcatggcaaaaatatccagaatcagcgaagtacggtccaaaatcttcactttcagttcagcttctatattacgtatctgcttggcagaaagttcatcatcaaaaatcaccattccgacttcacgctcattttcctcttcctgatgaatatattccttgatttcttccagctttcctttaccgacataggtcacggaattggcagcaggcagtttctgagtaaaccttttcaccactgttgctccggccgtttcggccaagaactccaactcatccaaatactccttggtcttacgctcatcttgtgtctgagtaatcaaaccaactaagatggcagtttcaacctgtgcttcagaaattacaaattctttcatttatctatcaatctaaataagttcgcgacaaatataacaaaaaaagaggatgaacgttgaacgtcatcctcttttttattacagttattccctatagttgtggttgtggagcagccggattgttatcagtgtcactgattccggaattggtttccatttcacattgcggaatccgatagatcaggatctgcgcttctgctgctgaattatattgtacagacgggtcataattcgtattcttacgaaccaccggctttttcaagcgtaggatatcgaacagtgagaaaccttctccccaaagttccatacgacgctgcaaccaaacctcatcctgaaaatcctgtgccgaattagctttacttgtaaaggaaggatcccgatatgtccgtacaaaattttccaatgtactctttccgccactcagattaccacccatggcttctgcctcagcctttatcagatacatttcttcaacacgcatcaaaggccagtctgacgcattggttgtgttaccaaatatactttgataagctccgaactttgtatttacatacggagtcaaaccaaaatattcaacgatggaagtaccctcaatctgctcattatcaatcaatgaagatttattatccggagacaagaaccattgtttacggatatctgtttcgggtattaaatcatataatgcagaattcacctttctatatccatcaggcactcctgaagtataaccgttcccggtaaaagagcacaagtgcgaaggccagttgataatacctgtctggacaacatcattatcaggcgtaatcatcactccccataaccatgaacttgccgatgctgaattaaaggtaggagtagatacctgggctaaagtctgaggtgtaccgccagcaatggcacgttctgcatctttagctgcatccgcccatttttgcattaacagattagcacgagcacgcaatccataaactactgcctcatcaatctgatctttgtttgagccattatcatacccggtcaataaatcagcagccgtattcaggtcactcataatctggtcatacacctgctgtacagttgcacgcggattattctgcatatcttcatcagtcattgtttctgtaacaataggtactgccaggctattttcatgacctgcataagtaaactgataaatttgaaccaagttcagatagtcataagcacgagcagctaaagcttggccacgataaaccttcaaagaagaatcttccgtatctgccgctatcaatttcaatacattgtttgcagctttcaagtgattatagaacgttttccaaatcaattcatcgcttgaactatcgtatactctgtcactataattctgagatgtattaaaccagttatatccattaaccaatgcaaccaaatcctgccctcctgattccaatatcatagataccgcaggaataccatagtcattatgataagtagtggcatcatctgaaatcgtaccaaaagtatttaatttggctgccatagcgttcacttcagcagttatcaaattaggtctgccattgattatatcttctttctgttcttcagatatgtaatctccttcaggaaatttatccaaatcgcaagatgccattaataaagcgacacttgcaaatgctatatatttatttgacaatttcatattcttaaaaatgggttgctaaattagaaatttaaagatatacctccggaaattgtgcggataggtgaatatacattgtcagcagccacataaccttgacgtgggtccaaccctttgcgagctgtcagcaaagccacattatctgcaacaaagaatacacggacaccgtcaatctgcattttacgtgtcagactcttcggcaaagtataacccaatgtaatattctgcaagcttaaataatccgaactagtcaagaaacgatctgttaatctgttcgtatattggtcattaatattcatacgaggaacatccgtatttttattttcaggagtccatgcttttaacatatctttatgcaaagcactacccgtggctgccacatccattaatccttgataagtatagtccagaatacgtccaccaagctgatatgcaaacgaaacagagagatcaaagccataggctgtaacacttgttccaaaaccaccataaactttaggtagaatatcacctgatgcgaatctgttttcagaagcgacagaataagatttcgtaactgtattaccattctcatccggagtcaccagcgcccacagactctctcctgtttcagaatccacacctacatatttaggtaaataaagctggtacatagactcatcttcacgataaatccgggcaccgtcaatcaattgtccattcagttctggagataattccaagactttattcttaaaatgtgtaagattaaagtttacattccaggaaaaattcttgttttcaattatattggaatacaagtccaattcaaccccacggtttaccattgaccccacattctcaggaaaacgggaataacccattgaagctgctaccggtttgaaataaagcatatcggttgttttacgtgagaagtactcaacagaaccacctaacttaccaccccaaaaagcgaaatcaaatccagtattaaagctgtgtgaagtttcccaagtaatttccttattacctttataatatagagaagttgaaaaatcgccattactgtttgccaatgtatactggtcttgatacggatagtagttacggtacaaaccaccttggaacatcaagttatcattaccttgcaaaccatagctgattttaaatttcaacatatcaatccaagactggttttccaagaatttctctttgcttaataaccatccagctcctacagaccagaagttaccccaacgattatccgggtgaaaacaagaagaagcatcacgacggaaagaagctgaaacaaaataccgtccatcatagtcatattgtgcacggaacagccatccttctgttgcataattacgagaatatgaattattgctctggttcataataccattgcctaattcaggaacattcggatcatacaatttctcacgttgtccgtacaaatattgatatttatagtcataactttcatgtccggccaaaatatccacattatgaacatcattaaatgttttgttgtatgtcaacaaatactgctgatttacactaaatgtacgctcactagatacgccgatcaaacctccgactccgctagtttcagaatactgtccgtagaaggggttaaccatctctgtagcacgcacattatttacatcaacacctatattcacttttgccttgattccattccaaatatcaatatcagcagaccattttccactaaccacatcacccgaatatttcattttatccagcatataactagccaacggatttgcattaggaatcgtattacggctaccatttgaatcttgtcctggctttccataatcataacgaaggaaacctcgattatctaccataatattgccctgtgcatcacgaacatacataggataaatggctcccataatatttgatgcataaaagatgtttgcatttgatgtaccaccctcagtatcctgttcacggctatcataatgagtaaatgatacatttcctcccatcttcagccaaggcttcacttgatagtcagctttcaaacgtgcagaataacgttggaaaccagagttaggaacaattcccttatcatccaaatagccggccgacatataataattcattttttcagtcgcaccgctgatacttaaattatactcttgacgcaggttattttcaaaaatttcatccgaccaattatccggagtataataatatgtaccatcagaataacctaatgtcgcattaggattcaatttgccatccataccgatcagttgctgtccttgaggaatggaatacacctgatatcccaaatatgtagaagaaagcattgcttgattagcgtacgcattagctttagccaaatctccggctgccgcatatcctttcaaatcggcattataaatagaagaatagtttaattcatagaatgtagccggatccgtaattgtttcataattaggtactccacgtttattcacaccccatttagcgtcaaaagtaacacgggcttccccactcttaccacgcttggtagtaatcaagattacaccattagcaccacgtgcaccatacagagcattagaagcagcatctttcaacactgtcattgattctatatcagaagtactgatagcagaaatttcaccatcatacggaactccatctaccacatacaaaggcttgttactagccgatatagatccaataccacgaatacgcacttcagcatctttgcccggctgaccattattactcgtagtttgtactccggctacttgacccgccaaagcatttgtcacatttgaagtttgtctcgtcgctattttttcattttttatagtagcagccgaacctgtaaatgcagattttttcgctgtaccataagccaccaccatcacctcttcaagctgctctgtatcagactttaacacaacattcaagtttgctttaactggcacttcttgtgtagccattccgataaaggaaactaccaaagtctttgcggaactaaaatatacaaaaaaacatctagtaatcaaatatttagcattctgctctcttgtagatatacaatattacatctattataacaaactataaatcaactatatattataacataaaaaaataatttgattttatgtctacttttattctaccttaaacataaaaaagatgcctagtaatctaagcatcttttttattatagacctattattagctattcgtttttatcagtaatctcactattggcatttaactccttatcggggatttgataaatgaataatttactacctgcagggacttcctttggagcaatcgcactatgattaattgcatgtgttctatccaaactttcattacgacgtttcatgtcaaataaacgacgaccttcaccccacatttcaatacgcttttgaagttcaatttcttgtaaaagtgcatcacttgttgcggatgtttcatattttggattacgagttttcataatcgtagtcagcattgttttggcttcattttctttccctgccctatataatgcttctgcagctacaaaatacatttcaccagtacgcaaataaatatagtcagagcaaaaagtatcacctgtaggagtaaaaccaggcgcggtagaacctatatcaataaatttgcgctgcacatattgtcttactttataatgagtatttgtttctcccaaatcaactccaaaccattttttacgaatgtcatcatctgaaattttttcatacaaatcactggaaatcattttgtaatttcctaaattaccaccgtatcccgggccgtaaggatcaacttgactcatgaatgaagcgtagaatgtatttgtttcaccattaatatcagccccccataacacttcgctcaaagaaaggtcattaaagccggaaagtaattctttttcactcatcagtgagccaccttcaatagccaattttgcgtatttagcaacttcattccattgatcgggataatcattaacaaatgaaagaatgtttgcataaatagcagctgctgcatattcatttaattcatctttcttggctattccttttcctttcaaataattatatcctttatctatatcacttaatatctgttcatagacctcacttacaggaacacgattcaatttggtttcagattcagtataaataggaatacctaatttatctttattccattcataaggttgctggtacatgtttattaaccaaaaatagcagtaagcacgtatggtgtaactttgtcccaacatcttctcaacactctcatcaccgctatctgcctgttctttcagaccgctgattacttcatttgcaccactgattacagcatataattcttgccaataagtggtcgtacgacgataacttgaagcacggttgtcaagcagataatcatatacgaagaagtgtgaggtcatatatgccatatcatctcccatcaagtctgtagccaattcaaatgcctttaatccgaaatcatcatgactttgctgtgcttccggagaaaacatatttttgtaatatcctgtaatatatgcttgaatagctgtaggatctttatcaagcaaatctttaatttggtcttctgatgcattttctgaaggttccttgtccaaaaagtcatcgctacaagatcccatcataaacgctgcagccaatattgctaaatattttgtatatttcataattctattcttttaaaagttcaaattaatgccgaatgataaagtacgaatcgcagaataattagcagccgaatatccataagcatattggcgtgggtccatacctttacgtttagagaataaagctacattatcggcagatacgtaaatacgtgcactgcttgctgatattgctttcatccattctttcggaaaagtatatcctaatgaaatgttacggatgttaaagaatgatgcatttatcaagaaacgtgaagattggctattactattttgtgcaccatccattataggcacatttgtatttttattttccggagtccaagcattcaagatatccttgtgccagttactgccaatattgcttcccgcatgcatgaaagaagaatacatgctgtcatatatctttccaccaatttgaaagtttgtagctatagaaagatcgattcctttgtatgcaaaatcagttgaaaaacctccttggaaatcgggcaaagtagaacctaattcatatttgcttgcctgagtatagtcttcggttacggtccttccagtcactttgccattagcatctttctcatccatataccattgtgctgctcctgtttctggattaacacctgcgtattcataggtataaagatcataaatagaccctccttccattaagcggaacaaagaagcagtaccatgaataattccattctctcttttgtcttctggaagattcaaaatcttgttgctataatgtgtaccgttaaaagataaattccatataaaatcttttgtttgaattggggtggcagaaatagtaaattcaatccccttattctgcatatccaacaggttcattggaacgtaagaaattccagaagaaataggataaggcatattgtacaacatatccgaagtcttcttcaagaaatattcagtttctagtttcaaacggttattaagaaaagcagcttccaaaccgatatttaaatttttgcttttttcccaagtcaaatctttatttccacgataagtttcgactacagagaaatctccgttattattggttacagaatattgcttcagatatggttgatagactacataaccatttatatcaagaattccatcattaccttgtgttccataacttgcttttagtttaagattagacaaccattccacatctttcaaaaactcttcctgtgttaatctccaagaacctccgacagaccaaaaagtaccacggcggtgatcaggatggaatttggaagattcatctgaacgaatacttgcagatagataatatttgttatcaaaatcatagtttacacgaccaaagaaactttccatactatgttcttgtgtatatgaattcatatcactcatagttatggcattgttgaactcaggatttccaatagtataaaaattgtatttatgagcatactgatatttcagtgtatatgaataagattcgtgaccagccattatgtcaatattatgatgaccaaatgctttactataggttaaaagttgatttgctgtaaacgattcaatacgttgattatatttataagtacgaccattcacattagcagcatccccatataactgattcatgtgatctgtacggatttgattcattaaatcataaccaatgttagcagtcgcttttaaaccatcaataatattaatgttaatagtaccacggccattaaaattgtcattcaaagtctgatgcacatccaacccagaattagctgcaacattttgattactgaaaccgcccatacgtgtactgtatgtaccatcaccaaaatcataaacagtgttgccttcttcgtcatatatgcgatttccgttttcgtcatacgcatatacaggataaataggagcgatttgctgagtgaacataaaagcattagagtaattagacaaactagcattttgtgactggcctgcatttttttccgctcttgcgtaagccaaattaccattgatatcaataaacttatttacagtatgattaatattggcacgtgctgaaatacgttcaaagtcagtatgtcttaagattccttcatctttcaaatatcccaatgataaaaaatgagttgtcttagcgttaccaccttgcagactcaaattatattcctgacgcataccattatgtaatgcggcatcagcccaatcgtcattatggcgtagagccgcagaactaactacgccatctgctgaaaccatggcattattagctacaccgatgaatggattgtatccaatgctacctattaattcttcggaagcttctgcacctgtagattgattttttaaagtattccaggctgttagtacgtattctctttgatctttcatgatatcatattctggaacaccacgagtatttactccccagcgtgcatcaagagtaactttggatttatctaccataccttttttagtagtaatcatcacaacaccatttgctgcacgtgagccataaagggctgcagatgcagcatcttttaatatagacatactttcaatatcggcaggatttaatgcattaaccgactcttcgtcataaggcataccatcaactacgtataaaggagccgatgatgcgctaaaagagccaataccacggattcttattttagcattttctccaggctgcccactggtattgattacttgtacacctgctgctgcaccttccaaggctttagatactgaagaaacctgcatttttgctattttttctccactaacagcagtcgctgatcctgtaaaagatgactttttcgcagtaccataagctacaaccactacatcgtcaagcatctctgtatcagattttaaaatgatgctaacattctgtttaatagaaacctcttgactagccattccgataaaggaaactaccaaagtctttgcggaactttggaaacaaagataacaatttataaatttacccctcagctttttacattgacccagaattagtagtgttatatgaaaaaagagtctaacgcatttgcgttagactcttttttcatataactgtttttattcgtttttcattgattggtcgatcacctcaatttttttcaagatcaattctaggtctgctttgagtttttccactttacgattcatttccgtaaccaaactgctaccttttttggaagaactggtcaggaagcccaaattgttctcgtatgtttgaatttcattcttcatgttttcgtaagcacgaaccagtttttcgcgttcacgataaaggttgccttccttgctgatggttgatttaaaattgcttaattttttctgtgatgcggaaagattcagcttgtcaaacaacttgtcgatgacaccatgatattgcttgtacagtttatctttttctttaaacggtacatgaccgatgccgttccattctttcattaattctcgaatggcgtttcccgcatcctcttccggtgtttcctgtgcgtcaattgcatttaatttttcaatgatcgcctttttctgaaccatgttttcctgttcaaccgagcgttgtgaagaagtcgccttgttcttttgctcgaagaaataatcacatgcggcaatgaatcgtttccatacggcatccgaatactttttaggtacaggaccgattgttttccattccttttgtaatttgcttagaatatcagcagttgctttccagtctgtgctttcttttagtgcttctgctttttcacataatgctttcttcttttccagattgcctgccatactttccttgatggatttgaagaactcggctttgcgtttgaaaaactcatcacaagcggcacggaaacgttcgaatatcttcacgttcattttttgaggtgcgtaaccaattgttttccatttagcttgcaaagcaatgatttcctgagttttgttttcccagtcttggaaagtagtgaacgtatcgtattccatcgcttccacaatttcacagattacggtcttttcatccaaattacgttgctctttttcttttaaggcttcgaaatgttgctggtgacgacggtttacggctgtagaggcagttttgaaccgggtccatatatcttcgcgcaattcttttgcaacaggacccgtattccggaattcctgatgtaacttttgtaattggtggaaagcggaaatcacatcttcttcatcagccaatttctctgcggcttcacagagatgagtttttatttcaagattctttttaaaatcatactcacggaattcattgttcagctttatcaagtcatagaacttttctgcatagtgctgataatttttccatagttcatttaccttggcagccggcacctgttttatatcgttccattcctgttgcagtttcttgaattcattgtatgctttgttggcatcttcgggagattcggcaagttctttcaagcggtcgataatggcgagctttttcaccaggttatcttctttttctttatcttgttctgcttgtatggcgcttcttttctctttgatagagctcatgatatctttgaaacggctttcagcatcgtccggttggggaataaatgcctcaggagcacctccgccatcaataaatgccttacgggcggcttcttgctcagccttgtgcagcttgtagaagttctgtttcaataaatccaactcttgtttgtctgcattgcaggcgtcttcgttgatttcttttaaacgttcgatgacctcttctttcgtttgtttaggtacatacgtagcgttattttcttctgcagtagcggaagatgataccaaagtttcagatgtctgttccactggaacttcggttaaagggcggatagtttcattcgagtccatcgtatagatttttaaagtaagcgtttttgttataacaacaatttacaaattaaaagaaataaattagaacttcatactgtttttcccgatttttttaggaaaatccttaaaagtggagaaaataggagaatcaagggggataaatgcactgcagattacatagattcatacagattctcttttattgtgattctttgccggtttctgtgtgaatctgtttttctctgaatttcaatctatgtaatctgtagtgaaatgtgtcaggatagtaatacggtgatgcccatataaagcatcatacctataatgtcattggtgatggatatgaacggacctgtagcgatggccggatctatttttagtttttccagtgtcataggaaccagggtcccaaagatggaagcgaacatgactactgcaaacaggctgaatgaaaccgaataagtcacggtggcacttgccccgaaacggatgaaattatagatatataccagcatagaaataatagtagcattgattacggccactacagattcctttactatttgtttccaggtgttttgggcatccagcgagctgtttgccagtccttgtacgataagtgccgaggactgtgttcccacattcccccctgttccgccgataagggggatgtagagggccatttcgggatgtgcggcaaaagtgctgtcaaagttgcccagaatcatggagtttcctattccgcctatcatgccgatgagcagccagggcagacgggctgtagtctggcggaatacattatcgtctgtttccacgtcttgtgacaaacctgatgccagctggtagtcgcgctcagcctgttcacgtacttcgtccatcacatcgtctaccgtaatccgtcctaccaggcgtccgatactgtccactaccggaacggcgaccaggtcatatttttcaatggtttgtaccacttcgtctataggggtatctacatggacggatatcggttctttcctcatcacgtgcttcactttggatacggaagggctggtgatcattttcttcaacgggaacacaccgcgcagccgctggtcatcgtctactacatatacataatagatttcgtccatatcttccgcctggatgcgcatttccttcagacattcgggcatactccagttttcgtttacgattaccatttcggtacccatcaatccaccggcagtgtcttcgtcatatttcaacaaatcgacaatgtctccggcttgttctatgtcttcaatgtgtgagaggacttcttcttgtttgtcctcgtccatttcacggataatgtccacggcatcatccgaatccatgtagtcaacgaaccgtttggcgattgtttcagagggaaggatttccaggaattctttacgggcgtcttcgtccatttcgataaggacatcggcggcagtctcattgtccagtaacaggtatatgaaccgtgcttcttccgcatccagttcattgcacagctctgctatgtcggcaggatgcagtccggcaagcaagtccttcagttgctctgagtctttttgctcgatcagctgctctactttttctaattcctctttattcatcctattcttccgttaatataataaataggtgttattctttcttgtttgttcctttccgggcgatatcattgctatagacaatatccgtcttgtttttcagcgccgcttccacctggttggtcagttcgataaactcttgtacagacaactgttccgggcgtttgttgaaaatggggtctgtgctcaatgggttctctttgtctaaaatggaagaaatagagtttctcaaagttttacgccgttggttgaatgttgtttttacaatgagcttgaacaatttttcattgcatcccagttccgtcgtttcattgcgtgtcatacggatgaccgcacttttcaccttgggaggcggattgaatacatgttcgtgtacggtgaacaggtattctactttgtaccaggcttgtatcaggatactgagaatgccgtatgtcttgcttccgggaccggcggcaatgcgttcggccacttctttttggatcattccggtacaacagggtatcaggtctttgtaatccagcattttaaagaatatctggctggatatattataaggatagttgccggtcaggacaaaaggttttccgtcaaataatttttcgaggttcagtttcaagaagtcgtcttcaatgatattatcttccagggcagggaagttctcacggagataggctacagattcatagtccagttccaccacttttaccggacggtttttctgcataataaactgggttagtacccccatccccggtcctacttccagaattggcaagtcagggcacacgtttaccgtatcggctatatcttttgcaatactgagatctttcaagaagtgttgtcctagaaatttttttggctttactaatcccattccgttatttttctatcgttaataaataggtttatttcgctaagatagtatctttgcatcgtgcaaaggtaaacattctaaattaatatacacagattttggaacgaactcgattaaaaaagattataaataaaggtttgcagattgcatttccgttatttttgggggctgcgatactgatatggatgtatcacggattcaatttttcccgggtgtgggaggtcttggatggaggaatgaactatgggtggatgttagtgtcattagtgtttggtgtgtttagccatatttttcgtggctggcggtggaagcttacgctggctccgttgggcgagcatcccaaaacatccgattgtgtgtatgccatctttgtgtcttatgccgccaacttggttgttccccgtgtaggtgagatttcccgttgcggggtgttggcgaagtacgatggcacgtctttctccaaatcgctgggtacggtggttacggaacggttgattgatacgctgtgtgtggcgctgattacaggggtaaccttgattatgcaggcaagggtattcgatactttctttaaagaaaccggcacggataccacggtcttgtcacaggtctttacctccgggcatttctatatcactatcgtctgtgtgctggccgtattggtactggccttttttctgattaggaatgtgacggtctttgccaaagtgaaaggcattctccataatgtatgggtcggtgtactgtctttgcgccatgtaaagcggatgtctctattcatcctttacaccattgccatttggacttgttatttcctgcaattctatgtttccttcttttgtttcgatttttccgataacttgggagtgatggcgggactggtcatgtttgctgtaggtagcattgcggtagtagttccgactcccaatggggcaggtccgtggcattttgctgtcataacgatgatgatgctctatggagtaggaaaagaagatgcaggaatttttgccttattagtgcatggaatacaaacttttttattaattttgttgggtatatatggattagcggctttgccgttcacaaataaaactaagaagttatgagtacaattctctctctcgctccgcagaatgtgtggaagcatttctattcattgactcaggttccccgcccttcgggttacttgaagaaagtgcaagagttcttgctgaactttggaaaaagtgtaggcgtagagtcattccaggacgaagccggtaatattatttaccgcaagcctgccactccggggatggaaaactgtaagaaggtgattcttcaggctcacatggacatggttcctcagaagaataacgatacagtgcatgattttgaaaatgatcctatcgagacttacattgacggagattgggtgaaagctaaaggcacgactttgggagccgatgatggcatgggtgttgccgctatcatggctatcatggaagacaagacgctgaaacatggtccgttggaagcactgattactgccgacgaagaaaccggtatgttcggtgcgttcggtttgaagccgggaacggtagacggtgatattctgttgaatctggattcggaagaagaaggagaattgtatatcggttgtgcaggcggtgaagacctgacagcagtgttggaatataaagaagtggaaacagatccggctgacattgctttgaaagttaccttgaaagggctgcgcggtggtcattcaggattggaaataaatgaaggacgtgccaatgccaacaagctgatggctcgtttcatgaaccaggtgataacttacgatgaggcttgcctggtgtcctggcaaggtggcaatatgcgtaatgccattcctcgtgaatgtgaagtggtcattacggttccggctgaagaagaagcggacgtactggaatttgtgcaggagtgcgaagcattgtggaatgaagaatatcatgtacacgaaacaccgatcagcttcaaggcagaacgggtggaattgcctgcgatgatggttcccgatgaaattaaagataatctggtggatgccatttatgcttgtcagaatggagtgatgcgtatgattcctactatccccgataccgtggaaacctcttccaatctggctatcgtttctatcggtggtggcaaggcggagataaaaatcctggcccgcagttcacgcgattcaatgaaggattatctgaatactgcattggaaagctgtttctctatggcaggtatggaagtaacccgttcaggtggttattcaggctgggaacccaatgtggattctcctattctgaaagccatgaaggagtcttataaggcacaattcggtacggaacctgctgtgaaagtgattcatgccggcttggaatgcggtatcatcggtgcggtggttccgggattggatatgatttctttcggtcctaccttgcgttctcctcactcaccggatgaacgctgctttattccttctgtaggcaagttctatgatttcgtagtagctacgttggaaaatacgccggtaaaagaatagtctttaatatcttataaagatttcgggcgcggatgatagggatttcgtccgcgcctttctattaatactccactttgtcacttttctctgtccattgttggaatgcctttatcgcctcttccgccaaaagaacttcggaaggcagcttgcgtgccgaaggtttcaggcttaactcatcatagataaaagagtcgtcaaaccctatattcttggcatccgtcttgttgtttgcataatacattttatccagccgtgcccagtaaatggctcccagacacatgggacacggttcacacgaagtataaatttcacatccgctcaagttgaatgttcccagtttgcttgccgccgcacggatggcgctgacttccgcatgggcggtagggtcgcattgtgaggtgacacgattggctccggtcgcaatgatttcaccatctttggcaattacggctccaaagggtccgccgccgtttgccacattctctatagaaagctcaatggctttccgcattaattcttctttcttcatagtggttctatttctttagtacagagcaaatatacgatatttccggctatatatgcgggagagggcttattttattcggaaactgccgcttcatgtgtacacttgtcggtttctgctaccattgaggtgattatcagtgcctccggggacattgccctgttttttgtttcagaagcttcagcctctccgcaaaagcccgtcaatagggcaaagtggctgaaggattgcctttggaaattccttcagcccgattatggaagcttcagtttttggttgttcgggatgtgtttgtggaagttcattttctctggtgcttttatgcctgttggaaatgatgttactattaggaagagtttgctgtgactgccgtaacagctttattgcttcaccttagtgaagcagccgttttatacaggtgacaatggatcttcaccaaagtggaatggcgtgttcacctaagtgatggacagaaaatacaaacttatcctgatgaaaaagaatatgtttccggttgtgtcagtttgctcatttaggggtgcgatacggtgacaagtgcctggatataggacttttgaagcattggggaaccaatctgtgcgtagtacgcatactcccagagggtgcggctgaaggattttttttcgggctgaagcattttccggtgtaatccttcagccggaatgcccactggcaaagggtttgcggagaggctgaagcttttgaaggaattttcctgtcctttttctttgtatcacgaatttgctgaatactcctggttttccgtaatgcgctggtttgggctaatactttgcaccctttcgggtatattatgcaaaagaagctaataaattatacccattagggtgtaattatcgctggttttgctatattggtaccctaaagggtgtaattatgaataattcattgtcattgtttgttaaggaaatgcgcaagcggttcggacttacgcaagtagatttggcagctaaggcgggagtggggcttcgctttgtgcgcgagttggaacaaggaaagcaaactttgcgaatagacaaggtaaaccaggtgcttgccctcttcgggtatgaagtgggagcagtgcctgcaggaaaggagcatagcgtatgagaaggggaaaaatatacctgaatgatatatatctacgcggggacgctgacggaagacgaaaatggttttacctttgtctatgatgccggattcttgcgttatccggctggcacctgaagaacttttcattgtatgatacggggatgggctatagtctgacgcctgcataccatttgctgtccacggttattgtcatgcccgaggatacggaggagctcgccggggggcagtggcaaggtaatagagaacatcgcttggaaattccgacgttccatcattaaatggatggaactgatagatgtttccttcctgcccgaagacatgaagaaaccctataaaagactggtgctgcaacgtttgctttggctgcgctgaaagatctttccttttctgttttagttattttaattaaaacgtatgcagtctttaaacatctatttcgtttctttgttaaagaagacttagtacgaactaaaagattgtagatatgaaaattcgttatttatctttgatagtgttactggtaatgagcgtatttgctcctatgcaggcacaaacctatgacaatttgtggaaagaactggaagtattggaacgaaaggatctgcccaagtcggttatttccgaagcaatgaaaatctacgataaagcaaaagcggaacagaatgtaccgcaaatgatgaaagcctatctcactgccatgcagtaccgttcccttttaactcccgatagcttgaaggtagatatgaatggtttggaacaatgggcttcccaaaccggcagtatggaagacaaagctatattgtattctattctgggtgaaatgaccatgcctgccgacgtaaaaaaaggattgggttatttgcaggcctctctcaaggataaggaccggttattacttatcccggtcgagaaattgagacctatggtgagagtgggagaggctagtaaacggtattttcgtgataatctgtacaacctgctggcacgtcgtgccatacaaatcatgcagcagtacaggtggcaggcggctgctaaagcaaatcagacaaacagtctgcctgcggatatgacggatatggatcaatttgttacttatcagtttgttcccgtctctgattgtgacctgacggcagctgtcatgcagacttatcagtccttgctgaaagcatacgatacggaaacggagcgtgagggttggttgctgaccgggatagatgcattgaattacctgtaccgcaatttttccggaaacttctcgaatgacgtatgccaacaggaactccggaagtggattcatacttatccggctgtgaaaacagtccctgaagcttatctggctttggcacaattcctacagtatcaaaataatcaggtagagcgcttgcggatagttcgtgaaggaatagccggatatccccgttacgaaggtatcaaccaactgaagaatatagaaaaggaaattctgaatgcaagcctctcactggaaatagctacggcttacccgggtgaacagcagtcggtgaaagtaaattataaaaaccttaccggcatcaccttgcagttatataaggtgaatttacccgttacctctgccgtattgcagaacagaaccacccattttgaaagtaaatatgcccgtttgcaacgcgaggagcatttttctttgaaacctactacagattatttgaatgtcgataccaccctgaccatacaggctcctcaagcgggaatttatttcttaaaggcagtgcccgatgggaagaagggcgtttcggacggaacattaatgaatgtcaccgctttaaagaccatttatcgtcctctgccggatggtacgttggaactggtggtggtagatgcagtgagcggacagcctgtttctgaggcggaagtaaccatttatacggagaaggggggaggttattctccccaacagacctaccaggcggataaacagggtactttgaaactggatttcctgaatagtaacaaatactggtataatgcacatacggcggctgataatgcgatgcccatcttgaatttttggaaaaacgattattactataaagagagcaagaggaaagaagttttgcaattatttaccgaccgctccatttaccgtcccggtcaaaccgtatatgtatccggcttggcttatgaaatggaaaaggattctacgcgtgtgctgacggataaaaaatatacggtatccctatatgatgcgaataataatgaaacaggaaaagtggaagtacggacgaatggttttggctcgttcagcggacagtttgttttgccctctccttgcctgaccggttattttagcttgcgtgtggccgatacttctgtcagttttaaggtagaagaatataaacgtcccacctttgatgtcacgtttgagcccgtgaaagtggagtatcaagtaggtgactctatagaagtggtggggatggcaaagacttttgccggtgcgcctgtgcagaatgccagggtacactataatatatctcgttcctatgcttggttctggcggtttatgggcaggggttcagcccgttgggagggagaggcaatgaccgatgcggatggtaagttcagcgttccggtgcattttgaaatagactcggacaggagagaatctccgttgtggtattatacgtacaacatacaggcggatgtgacggatggtgcaggtgagacacagcaagctaatttgtcattgcctttaggaagcacttcaatggtgctgaatatggataacctgcccgataatttggtgaaagaaaagaagctggaaataaaactgacagccatgaatctttcgggtgagccggtagatactccggttacttatcaggtagtcgagatggagaagcagaaagacggtcaggaaaaagaaggcagaaaggtattgaccggtacggtggaagctaacaagagttttattcctgaggctatttatgccctgccttccggtaattatcgtttgaagctttcggctaaggatacgcagggcagagagtgtacggcatttaagaatttccttctgttttcattgaatgacaagcgtccgcccttcgtgataacggattggttctatcaggatggtctggaatttgatgcagcatctcccgcgactatatatataggtagcagcgaaaagaatgtctatctgctttatgatgtatttgcaggaaataagcgcttggaaagcaaacgtatagagctttcggactcggtggtcagtttccgcttcccttataagaaggaatatggtgacggcattctggtaagtatggcatttgtgaaagatggcagactttacagtcataatgcacggattatgaaaccggcccctgaaaagaagttgcagctgaaatggactacgttccgtgataaactccgtcctggacagcaagaggaatggaaactgacggtactttatccggatggaagcccggctgaggctgaaatgctggctactatgtatgatgcttctctggataaaatctatagtgcacataagttggactttggagtggactttcattatgtggttcctttgacttattggaatacatcctatatgcggaatgcttatttgtatgttgatttcccgttgaagaggctccgtgcggttcctttggaatatagtgaattgatcattccatctacaggaagaatggaggctatggtggtaggttacggaggcagtcctcgtgccactcttgcaggagctttgaagattagaggcaggagtgccgcaaatgctgtgatgaaccaggaggctgttactgatatggtgctccaggaagaaatggtagaaacatctgcacaggaaaaggtagaaatgggcagttctgaagaactggcagaaacgggtgatatacagatacgtgaaaactttgcggaaacggcattcttttatccacagctccgcaccaatgaaacaggtgaaatcagtatttcctttgtactgcccgagagccttacccgatggaagtttatgggcttggcacatacccggaatgtggattatggaaagatagaagctaccgctactgccagcaaagagtttatgcttcagcctaatatgccccgctttgtccgcgtgggagataaggcgaatattgccgcttcactgatgaacctgtcggacaagggagtgaaagggactgtccgcatggaattgtttaatccggaaacagaaaaggtattctattcacaaaaacagaagtttgatgtgaagggaggagaaaccgggcatgtgaactttacttttgaagtgagtgacaaatatgcggtaatggcatgccggatggtagcggatggagataccttcagtgatggagaacagcgttacatccccgttctgacagacaaacagtgggtgacggaaaccgttcctctgaacgtgaatggggaaggtgcgcatactttctctttggaaaacctgtttaacaagcatagcaaaacggcttccgaacaacggttgaccgtagaatttactgcccatccggcttggtatgccgtgcaggctttgcctgtagtggctcatcctcagaatgaagatgctctttcctgggctaccgcttattatgcccattcattggctgcatatatagtcaaagaaaatccccgtatcaagcaagtctttgatagctggaaggctcaaggtggcacgaaggaaacttttatgagcaatctgcaaaagaatcaggaactgaaaaatatcctgctggctgaaactccctggctggcagaggctaccaatgaagccgaacaaaaacagcgtatcgccactttgtttgacctgaatacaatgaatagccaactggctgtttctgtagaaaaactgggagaattgcaaaatgccgatggcgcatggagttggtataaaggtatgcaaggcagccgctatgtaactactcaggtaatggaaatgcttgtccggctgaatgcattgacccatcaggatgctgacagccggatgcagcctatgattcaaaaagggttcgagtatttaggcaagcaggcagccgaagagtataagtccatgaaagaagctgaaaagaaaggggctgtcggtatccgtccgtcagaacaggttctcaggtatttgtatatctgtgctttggatggcaaggctccggttgatgaaaaggtgaaccggtattttatagacaagttgtccggtgagggaaaagaactgacgatttatggaaaggcgttgggagctatcatcttgcagcaatccggtaaggtggcagaagccaggctgtttatgcagtcattgatggagtattctgttgtgacggatgaaatggggcgttactttgatactcctaaagcccgatattcatggttcagttataaaattccgactgaagtggctgctatggaagctatacagcgtataacaaaagatacgaaagctattgatgaaatgaaacgctggctgttgaagcagaaacagacacagacttgggaaacgccgattgccacggctgatgcggtgtatgcattgatggctacaggagcttcggatttattggcaaatacaggaggagtagagattactttaggtaaagaagtgatccggactccggcagatgatgccatcggttatatcaagaagacggtgtccggtgatgtgatgaatatcaagaaagtaagggtggataaagaaggagccggaatgggttggggagccgtttatgcccaatatctggaaagtatggatcaaataggtgagcagggaaacggattgtctgtcagccgtcaattatataaaggagatgaggctttgaatgaatcagttccattgaaagttggcgataagattaccgttcgcctgactgtgaaggctgaccgtgatatggattttgttcagatcaaggatgaccgtgcagcttgtatggaaccgttacaggcagtttcgggattccgttggggcaacgggctgggatattatcaggctaccaaagatgcttcgactcagttctttatcgatcagatgagaaaaggaacttatgtgatagagtatcaggtgtatgtgaaccggacaggagaatatcaggccggaattgcaactgttcagtctgcttatgctccggaattcggagggcatacgggaggatatcgggtgatggtggaatagagaaacaggatgtctggaattagttgtgtgatttcataaaaagtaagttagcttgctaacttactttttttcttatgcttctgccgtccacccattctaatcttatttcaaaaccatcttcagccgtgccataaaaatagcggcctgaaacggatggatattcaattataaatgtataaccatctgaataatatagatataaccaaccgttttgaatttcccagtcaaacttatataccctataaagttcatcatcatagtaacagcgttcttccgtacctacaccatgatccgggaaagcacctgaggtgaatgtaatataactgtaaagccgttctccgtatgggtcctcaaatcccatttcgccccaccaagtcttaccgtataatcctgaaatatcaaatcctctttcttcatcgttttcacatgaagaaaaacttatcattgtaatcaatgcaatggcaatgaaccagtaatgttttactattttcataatttatctgatttttaatgcgggacaaagataaaggttattcataagataaaataaattataggctgaaaaaatgggtaaaggatgttttttgtctatctttgctatctaaaaagcataaaataattgtatgaaacatattatactgatagtaagtttgttaatgggagtgactttgggagtacaggcacaacccaaagcattatttgataagacaacgcatgaatttggaactattttatggaaaaatccggtgacggcaacttttaaaatcattaataaaggagataaacctttagtgatatctaatgtgacaacgtcttgtggctgcacggttgctgattggaccaaagaaccgattgcaccgggaaagaccgggattgtcagttctacttttgacgccaaagccatcggacgttttcagaagagcgtaggcatttattgcaatgcctcgaataaacctatttatctggctatccggggagaagtaacagccgatcctaagaattatactttcactcatccttttcaaattggcgctattcgtctggataaggaagaaatagagtttgaggatgccaataaaggtgataaaccgactatggaattgttggttgccaatacgtcagataaactatatacccctgtgctgatgcatttgcctccttacctcagtgctgttgcaactccggaaaaattaggaaggggacgtacgggtaaaatcaagatcactcttgatacggataagctgcctaaattgggcttgacaacagcttctgtttatctatcccgttttccgggagataaggtaggagaggaaaatgaaattccggtttctgccatattattgccggatttctcgcatatcagccagcaggaacgcttgaatccgcctgccattcatctttctgccaaagagttgcagatgggagaactgaaaagcgatgaaaagaaagcacatacgattattgttaagaatgtaggaaaatctaatctggaaattcttgatttgcaggtgtttaattctgctttgggggtccagttgaagaaacgtgtcttgaaaccgggtgcgtctaccaagttgaagattactgctttcggtcaaaatttgaagaaagtaaagggtactccgcgtgtcttgatgataaccaatgatcccaacaatccgaagataattataaaagtaaaagtaacctcaaaaaaatagctatggaacatcctgaaaatagtgaagaatataagggattgacagtgaacaaaggtattgagcaaccatctattgtgaatccttatttgaaactacgtaaaaaacctcgtcgtcgtgagttttccgtaggtgaatatgtagaaggcatcgtaaaaggtgatgtgaccgtattgagtcaggcggttactttggtggagagtgtaaaaccggaacatcaggctattgcccaggaagtgatagagaagtgtctgccttattccggaaattctatgcgaatcggtatcagtggtgtgcccggtgccggcaagagtacatctattgatgtatttggattgcatgtgcttgagaagggaggaaaattagctgttttagctattgatcccagtagtgagcgttctaaaggcagtattttgggagataagacccgtatggagaaactatctgtccatccgaagtcttttatacggcctagtccgtcggcaggttcgttgggaggggtagctcgtaagactcgtgaaacgatcatactttgtgaggcggcgggctttgataagatttttgttgaaacggttggagtagggcagagcgaaacggcagtgcattctatggtggatttctttttgctgatccaactggccggtactggtgatgaattgcaggggattaagagaggtatcatggaaatggcggatggaattgttatcaataaagccgacggcagcaatattgagaaagcaaaactggctgccagtcatttccgcaatgctttacatttgtttcctgctcctgattcgggctggagtcctaaagtaatgacgtattccggcttttatggtattggaattaaagaaatctgggatatgatctatgaatacttcgcttttgtgaaagcgaatgggtattttgaatatcgcagaaatgaacaggctaagtattggatgtatgagtctatcaacgagcatttgcgtgatagtttctataataatgaaaagataatttctatgttggctgcaaaagaggaagaggtgctgaatggcaaactgacttcgtttgttgctgccaaaaagttattggatgcttatttctcaaccttgaaataaggttttcctactactacaggtaacataaaaaacgcagatttaatgaataattataatctgcgttttttgtgtacctgtggtggataaaaattagatagaaagttcatgaagtacgttcaccaattctctgtctataggcttgtcgttctttatagctttagcgaaaggtacataaacaatcttatcatcatcaataccaatcattacattacgttgtccttccaatagtgcttggatgctagccactcccatacggctggcaataattcggtcatgcgctgtggggcgtccgccacgttgcaaatgtcctaatatcgttacacgcacatcgtattgcggatattcgttcttcacacgttcggcatagtgcattgcacccccggtcagttcgctttcggctactaatacgatactactgctcttggatttgcggaaaccatgttcgatgaattcttccaattggtcaacttctgtgctgaattccggaataatagctgcttctgcacctgcggcaatagcgccgttcaatgccaggaaacctgcatcacgtcccatcacttcaacaaaaaataagcgttcgtgagaagttgccgtatcacggattttatctactgcatccaaaattgtgttcaaagctgtatcatagccgatggtggtgtcggttccatacaggtcgttgtcaatcgttccgggcagaccgatacaaggcacatcaaattcctgagcaaagatacgtgcaccggtcaacgaaccgtcaccgccgataatgaccaaagcatcaatctcgtgctttttcatattttcgtaagcttgtgcccgtccttcgggtgtcgtgaattctttgcaacgggcggttttcagaatggtacctcccatttgtatgatgttgctaacattttggcttttgaattcctgaatttcatctgttaccaatcctttgtaacctctataaatgccatatactttcaagccgttatagatggcagaacgtgtgactgcacgaatggcagcattcattcccggagcatctcctccagaggttaaaataccaatacttttaatcgttcccataaatacccattttaatatttttatgtcgcaaagttaacaaattatcagttggacaacgataattttctattttttattggtctatttttcgtttaagattgcttttttacattcttccatcaaccatttgggggtggaagtcgctccacaaatgccgatggaacggacgtcctcgagcaagttccggtctatttcttccggctggtcaatgaggtatgaattcggattgatctttttgcattcttgatataagatctttccgtttgagctttttcgtccgcagacaaaaaagatcagatcatgcgctgctgcaaatttgcggatgttaggcatccggttggccacttgccggcagattgtgtcgtaatattcaaaagtggcatcgggtgagatatgctccttgatatattctatgatttgccagaattcttccaaagacttggttgtctgggagtacaagcgtatgtctttggtgaagtccagatgagcagcttcagcaggtgtttctatgacaattgcttttccatgagtttgacctaccagccccagtacttcggcatgaccgttcttgccataaatcacgatttgtgtgtcttgacttgccggaacattgtcatactcctgtttgatgcgcttttggaggcgtaatactaccggacaggtggcgtcaatgatctcgatgttgttggtacgggctatagcgtatgtttcaggaggttctccatgtgcgcgcaacagtactttggcatcgtgtaattgggcaaactcttcgtggtttattgtgataagccccattttttttaggcgttcacattcctgtccgttgtgtacaatgtctcccagacaataaagagtgtttccttttgccagttcttcttctgctttacggatagctgtggtgactccgaagcagaacccagatccttcgtctatctctatgttaaccatttatcgcagcttgaaatttttcggtcagccactttttctgttcggcaatgctcatgtggctgttgtccaacaagatagcgtcatccgcttgccgtaacgggctgacttcacgggtttggtctatacggtcacgctcttccacattttccagaattttttcataagaggcttcttgccctttacttcttaattcatcataacggcgctgtgcacgtatggcagccgaggcggttacaaatattttcagttcggcatcggggaaaacaacggttccaatgtcccttccgtccatgacaattcctttggcctttcccatttcctgttgttgtttcaccaaagcctcacgtacaaaacccaaggcggcgatagggcttacatgagaggaaacttccatgctgcggatggcatcctctacatttgtatcgttcaggaaagtcatggggcgttgtgtctccggatttaaccggaatgaaatatgtatatcgggcatcgctgtttttaacgcttcggtgtcgatgcctctttccgtaaagaaccctttctgcaggctatataatgtaacagcacgatacatggcaccgctatcaatataaatgtatcctatttcacgtgccaagtctttggccatcgtgctttttccacatgatgaataaccgtcaatggcaatagttatttttttcatatataattaatgtataggtgactactaaaaacgcttcaaagatagataaaagttgggtgtatgtctatgaaatcggatgaaaataaaatgaattagcatatttttcatgtgaaaatactttttatttaaaagatttgtgttacatttgccctcagtgagaaacacttaattttaaaacacaatttatggaagttaaaaaatcgcctaaagcagatctcgaaggtaaaaagagtacctggctgcttatcggttatgtgtttatccttgctctcatgtttgtagctttcgaatggactgatcgcgacaagcaagtgactacggaaacaggtataaccgatgtcgtatttgaagaagaaattatccctattacggaacaggaacaaaaacaagctcctcctcctcccgaagctcctaaggtagaagaagtgcttcagatcgttgaaaacgatgctaaagtagaagaaactgccattcaggcttctgaagaaacaggtcaggctgtggaagttaaatatgttccggtagaagtggaagaagaagaacctgaagaacagcagatattccaagttgtagaggaaatgcctgaattccccggaggtatggctgaatgtttgaagttcttgggtaagaatattaaataccccactatttctcaggaaaacggtgtgcaaggtaaggttatcgttcagtttgtcgttaataaggacggttctatcgttgacccggtggttgtgcgtagtgtagacccctacttggataaggaagcactccgtgtaatcaagaccatgccgaaatggaaacctggcaaacagcgtggtaaagctgtacgtgtgaaatatacagtgcctgtaactttcaaattacagtaataaaatactttaatatcttaattaagaggctgcctttaaaaagcagcctctttttctagaaccccttaatcaaaataatttatggctttttctgcagaccagttattggaaaaggtaaatacttatcttgctacgatgccttatgtgcgcgaaccaaaaggattgtatgctcctatagagtatgtcttgtcattaggcggtaaacgtatccgtcctgttttgatgttgctttcctatcagctttacaaagagaatgtggatgatattttaccacaagcggcaggtatagagacttatcataattatacattgttgcatgatgatttgatggattgtgcggatatgcgcagaaacaagcctaccgtgcataaggtttgggatgagaatacggctattctttcgggggatgccatgctggtgttggcttatcggctgatgaacaattgtccggagcgttatttgaagcaagtgatggatattttcagtcagactgctttggaaatttgtgaaggacagcagtgggatatggaatttgaaacccggaatgatgttactgttcccgaatatatggagatgattcgtttaaagacatcggtacttttgtctgctgcgttaaaaattggtgctgtattagggggggcttcggaagatgatgcccgcaaattatacgatttcggtatcaaaatgggattggcattccagttacaggatgattatctggatgtgtatggggattcgaaagtgtttggaaaaaatataggtggagatattttatgcaataagaagacttttatgctgatcaatgcgttggctttggcagatgggatacaacggaaggagttggaaaaatggatagcttctactgctttttgtccggaagaaaagataaaagctgtaacagctctttatgataagataggcatcggcggaatttgtgaagaaaagattaacgcttattatatcgaggggctttcgttgttggaaagtatagctgtgccttctgaaagaaaagaagaactgaagtcttttgtttgtcatttaatgaatagaaaagtataatatgattgacacgcattctcatttgtttgttgaggagtttgatgaggatttgccggctgtgatagaacgtgctcgggattccggagtgtctaaagtctttatgcccaatattgatgacaccacggtggaagcgatgttgaatgtctgtacggcatataaggggtattgttttcctatgattggatttcatccgacttctgttggggctgattcgttattccgtatttatgagatgaaaaagctgctttccggtgaacatccttttgtggctgtaggtgaggtgggaatggatttgtattgggataagacatatttgaaagaacaacagaaggcgttggatatacagattcaatgggcattggaatatcatctgcctttggtgttgcattgccgtgaagcttttccggagttgtttgaagtgatggaaccttataaaaaaactgagttaagcggtatctttcatagttttacgggtactctggaggaagcagggcaggttttagagtatgctcgttttttctttgggatcaatggagtcgttacattcaagaagagtagtctggctgaggtcttacctcatattcccttaggcagaatcgttcttgaaacggattctccttatttggctcctgtgcctttcaggggaaaacggaacgagtcttcttatataaagaatgtagcgatgaaacttgccgaaatctatggtctggattttaaagatgtggatagaattactgccaataatgctttaaaagtgttcaaaatggctgaataagtttttaaagtttattaattttgataggtaatttaaatattggcagggctaattctacgtaagacgaaaaaaaagaatacatttgtagctgaaatcgcttgcagttcccgattttctttgtaatttgcacccgattttaaaaaagatagtattgtgtcgcccgaaaaggagagatgctcgagtggttgaagaggcacgcctggaaagcgtgtaaacgccaaaagtgtttcgcgggttcgaatcccgctctctccgcattgtaatggaaagcacaacagactggaagacaattaaaacaaataaataacaattaattaattaatcttaaaaattagacacacaatgaaaaagttatttgcaattcttgcagtgatgggagtccttactttaggatcagttcagcctgttatggctcaagacgcagctccggctcaaacagaacagactactgaagcagcagtggttgaagaaggtggtggtcttcacaaagagttaaaaaccaaatttattgaaggtgatgccagcttcatgtcattggtagctatcgcattggttttaggtttggctttctgtattgaacgtatcatttatttgagcttggctgaaacgaatacaaagaagttgatggctaacattgaggctgctttggaaaaaggtgatgttgaagctgctaaaactgtatgtcgcaatactcgtggtccggtcgcttctatttgttatcaaggcttgatgagaatagatgaaggtattgatgtagtagaacgttcagttgtttcttacggtggagttcaagccggttatttggaaaaaggatgttcttggattacattgttcatcgcaatggctccgtctttgggattcttgggtactgtaatcggtatggttatggcgttcgataagattcagcaggctggtgatatttctccgacagttgtagctggtggtatgaaagtggctttgattactactatcttcggtttggttgtagcattgattcttcaggtattctataactacatcctttctaagattgaaggtttgacaagtgaaatggaagactcttctatcactttgttggatatgatcactaaatataacttgaaatacaaaaaataattaggagatggctaagttatcatataaagtgtcttactacataatgtacatttgctttgcgctgattcttgtcgtgctgggaatgttctattttgtaggatacaataatccggtaggtgaatataatgcacctgaacatacggaaacattgatttacttaatgtatgcaatgtttggaatatgtgtggcagtaactgtaattggtgcgatagcacaatttggcgctgctttgagagataatcctaaaagtgcaataaagtctttgatcggcttggtcttgtttgtggtagtattggtcgtttcttacggtatgggttctgactctcctgttgttttggccgatggtagtgcttacactgatacaggttggttgaaaattactgatatgctgatttactccatttatttcttgtttggtgtggctgcaatcggtactttagtaaacttgagcggtatctttaaaagataatattatctacattgattaaataatttaaaacgaagtaagtaaaatggcaagaaaaaaaagaggcgtacctggaattaactccagttcaacagctgatattgcctttatgttgcttattttcttcctgataacaacatcaatggatactgaccgtggcttggcgagacggcttccgcctcctcccgaaaacaaggatcagaaagatgatgatattattgtaaaggaacgaaacatccttcaagtccgtctgaataaagacaaccagctgatgtgtggtacggactatattgatgtgaagcaattgaaagaaaaggcaaaagagtttatagccaatccgtatgatgatgaaaatctgcctgaaaagcatagaaagaatattcctttgctgggtgattgtatgattacggaaaatcatgtaatctctgttcagaatgacgttggaactagctatcaagcatatattgatgtgcaaaatgaattggttgctgcgtataatgaacttcgtaatgaactaggtaaagctaaatttggaaagctttataatgagtgcaacgaagatgaacaaaaagctattcgtgaatattatccgcagaagatttctgaagctgaacctaaaaagtatggaggtaagtaatgggaaaatttaataaaacaggtaaacgtggaatgcctgagttgaatacctcttcattgcctgaccttatctttaccatgttgttcttctttatgattgtaacaaccatgcgtgaggttacattgaaggttcaatttcaggttcctcaaggaacagaattggaaaagttggaaaagaagtcgttggtttcctttatttatataggtaaaccgttgccggaattccaaaagaaaatgggtgctgaaagtcgtattcagttgaatgataagtttgctgaagtgtcagaagttcaggactacatttatcaggaacgtgagaatatgaaagaagaagaccagccatttatgacagtatccttgaaagttgataaagatacaaagatgggtattgtacaggatgtaaagcaggcacttcgtcaagcttacgctttgaaaataaactattcagctactcaacgtcagtaatagttatataagcatagataaaaaaggaagctgtttttaacagcttcctttttttatgttttccattctatttgttatggacgaatttatccgttacctatggctagtaatagtacgtacaatggattttttgaggacaaactcctgtgtggtggctcagggaattgaagaaaaagaatgttcagatctcttgtccgtaaacttctttgtaaagagtctttttaactttctcaaaatcactttccatatctatatccccataggtcattaagagcattggtaggccgctatctcccttacggtagggaggttgtatatagggctttttatgtaaagtgaattccaaacgtttatagaagtgaatacggcgtgtgctcatttcatcattaggctcctctacttccaatacaattggaccttttaactgtttttttatcatttccagcacacgttttccataacctccgtttctgaggctgggatcaatagcgaaatgttcgatatagtaaaaatctcccattgtccaatagctgatcataccaatgctgttaccgttttctaaaataatgttgttgcagaaccggggattattatcagaatattctctctgctgtacggtatcacggcgttcttcttgagggaatgccgtatgcattaatttttccacaaaggtataattaacctcatcttgtgtttttacttgtttaatttcaatcattttatctgtctttgtttagtcttaagttatgaacctatttcgcagtataaaagtttattagtctttctaatgcacgttggcataccgggcagaatgcaggtgcttcgtttatcttcattctgcattcggtagtaggacgataaagtcctttttgtgtatagcctgctccttcatagacacccaccttggtgtataagtcggcattttctgtagctaccggagtaggtatggcagtaccttccggaatcatatctttccatttactgtcgaaatcaattaatgtggtgatatttggctcccaaggttccacttcatatggatattgcgggcttggggcttcggtatatgcatattcatctgctaatcctccaaaactatggccgaattcatggactacaaccggttgaaaatcaggatgatgggctgtggtcagtgtatatgagttatagatgccacctcctccataggtgtctgtattggctagaataatgatatgctcgtaaggaattccagccaaccaattatgaatactttttacccgactggtagtgagataccggtcggaatagaacgtgttgaaatgtgaacttacagctgtagatttccatttgccttgtcccggtatgctgactccgctgtcttccgaagggcttgccacagcgacaatattaaatttgtccttcagtttcttgaaaggttcatgactgaacagggcgtcacacgctgtctgggcatctttataaaatatatccatctctttttctgtatatccttctgccatgattgctacatcgatgcaatctgcggcatttccgttttgcagaagatagcgatgaggggtaatatggtttgttcccctctgatggatcagaatatcattggggattatttcatgtgtgagtgaggcatttactttatgatatacatcttttagagatatggtcactactgcttcttttttgggataaggcaaaagaaaagaattctcgaagcctctttttatcctacttgcttcttcttcgcttacccattcttggaaaaggctagagaatgacgttcgataaatggtttctcctgttgctttgtctttcattgtgatttcaccgttgcctgccaaaggaagttctgctagatgatgcttgcgtcctgcccattgcggaaggcttgacagttcgtccagatatacttcttgttttttggcatctccggtaaaaatataatctgcccgaagtgttttatcttcgaaataatcactgaaattttgagcgtttacagtcatgctgaataaactgcacaaggtaaaaataaatgtctttttcatcgtctttgcattttctgcaaagataggacattctattaaattattggtatttatacaataaaagttatgaatcgcacgaatattgtcgggaaaagtcatatctttgcagaaaattaaactaaaaagaatgggacatcatcaattagacagtttggatgagcagattttgaggttgatagccagtaatgctcgtattccgtttttggaagtagcccgtgcttgcaatgtatccggtgcagccattcatcagcgtattcagaaattaactaatctgggaattcttaagggatctgaatatgttattgatccagaaaagatcggatatgagacatgtgcatatattggtctttatctgaaagatccggaacaatttgattcagtgacagaggctttgaaaaatattcctgaagtcgtagaatgtcatttcactacgggacaatatgatatgtttatcaagatttatgcaaagaacaatcatcatttgcttagcataattcatgataagttgcaaccattgggcttggctcgttcagaaactattatatcttttaatgaggctatcaagagacaaatgcctatcctcgatttagctgatgaagattaatcgttactttatccggctataattaataaaactatacgggtagagatgtttttcatctgtcgggtgatcttctctgcctgtttctttccattcctctttctttatttcgggaaaataagcatcagcttccttggatgtgtcatcaataaatgtgatatataattgttgggctatatgcattgcctctttatacaagcttgcaccgcctataataaatatttcttcttcttctttgcagtgggataaagcgatttccaatgcagggaaacattcagctccggcaaagactgctccttcccggcggcttaatacaatattccggcgattgggaagtgctcctttgggaagtgattcaaaggttttgcgtcccatgatgatagtatgtccggttgttaaagctttaaaacgtttcaaatcgttgggaagccaatataataatttattttcaaatccaatgccgtggttgcgtgctattgctactataattgaaatattcatagtgatgagtggttagtggtgaatgtttagtgatattagtggtaagtgatgaataagcttgtgcagcctattcaccataactgctaaacagatactttacccgcaatgtgtggccatggatcataattcaccaattcaaaatcttcatatttaaaactgaatatattcttgatatccgggttgattttcatttgaggtaagggacggggttcacggctcaattgaagttttacttgttccaagtggttggtatagatatgtgtgtcacctagtgtatgaacaaaatcaccggtctgtaatccggtaacttgtgctaccatttgcagcaacaatgcgtaggaggcgatattaaaaggtactcccaggaatgtatctgcactgcgttggtaaagttgtaggcttaaacgtccgttggcaacgtagaattgaaaaaaagcatggcaagggggaagattcatgttatttaaatcggctacattccatgcactgacaatgatgcgtcgtgaatccggattatgcttgatcgtttctattgcttcggaaatttggtcaataaagcctccattgtaatctggccaggaacgccattgatagccgtagatatgtcctaagtctccgtttgcatcggcccattcattccagatgcgtaccccgttgtcttgcaggtatttcacattggtatccccttgcagaaaccacagaagttcgtgaatgatggattttaaatgcagctttttggtggtgaccaaagggaaaccctcttccaagttgaagcgcatttgatgaccgaatacgctgatggttcctgtaccggtgcgatcctccttgtgaacaccttcggtcaggatacggtttaataggtctaaatattgtttcatgttcggatattcattttatagattgcaaaagtacacaaaatttttctttttccgagcatgaccctagttctatttcagttttcaccatttcaggctgcatacacgttgtaagccgatgatgataagaaccgcagtggcgataaccagtgattggaaattagtatcacttaccaaataataagtttgggaagtgactatgtcactgattgtctggcatagaatttcaaagccattgaaaatatagaataatgcacaacagacaatggcgcaagttacactgagtatatccgataaccattgggctggttgggggaggcggcggataaccccgcgtgaaaatccattgtcctcaatttcatgtttgttggcaagcatgaaattcttaattaatgtatcatcgttttccatcataaccattctgttttaagaaagttgtcaattttgtttttccgcgtgataaatgggacttgattgttcctgcaggcattcctgtaatcactgcaattttttctatcggaagatcttccataaaaaataaggtgatgcaggttcgctctacctcttttaattggctcaatccccgatatatgtccatgtgttcacctacttgcctttgttctgtttggtaaacagcgtctatttcccaagtttccagtccggacgtttcttttttgctgcgaatatagtcataaaatatattataagcaatacggtaaagccatgtggagaaactggacaaatttttaaatgaagccaagttggtgtatgcttttataaaagtttcctgtgccaagtcatcgctgagctctgtatctcccaatgtttggtgcaggaaaaaacgcctgatgggcgattggtactttttgaccaaagtatcaaacgcccgggtgtttttaaagaccaccacttgtgctaccaacgctatgtcgttgatttggctcatttttattcttcgttgtagggagtgtctatattgttctttatgttttgtgtttctttggcctctttgttacgtcccagttcaatattttcaattttcattgatctgactccgttttcatcttggtttattcgggtaggagggaaaggatcatcttttttctttttgtgtggagtggtagtgtaagctatcaatacttgtcccaaccccatacagaaaataaggaatccgatagctgccaatccttcttcttctgtcagtacccaaaggaatactcccaaaccaatgcctaagaatatattcttgatcccctttgtcattacagcatttccttgttcttcggggtcattgaacagttcggccggaatggttcgtcctgctgccagagcctctgcagccagtttgtatttggcttgtttgttcttgtacctgaaccaaagtacaatagctacgataaagaaagggaggccacaacagatgatgagtgcgacaattgctaccgaagtaggaggaccgctattccaatcaccgaaatccgaactaatgtcatgcatggcagcattctgatcttcatttacatcttgcaggtcgcttataacgactgtatccatccgagtgctgtcaagggctgaaggtactaatttgattgttttggcatgggttgcgaagcaagtccctatgagtaaggtcaaaataaaaagtaactgtttcatgtttttatatctttattattgttttctgctagttagacggaacgaataaggaaataggttgcaaatagacagaaaattttctgataatcccaaaatatcatcgtatttttgtaacataaaaaggaaggaacatgaaattaccatcagaatttgaagcaagaaccctggaatggatgggagaggaaacttatcgcgcgttggaagcggctttgcagacggagcctcctgtcagtattcgtgtcaatcgtacgaagtggagtggggaagttgcaggagaaccggtactttgggcatctgcaggggtttatttatcgcaacggcccacttttacattcgatccgttgtttcatgctggttgctattatgtgcaagaagcatcttccatgtttgtggaacaggtattacgcacttatattaccggacctgtagtgatgctcgatttgtgtgctgctcccggtggcaagtctactcatgcgcgttcagttctccccgtaggtagtttgttggtggctaatgaggtgatgcgtaaccgttctcaggtattggctgaaaatttgataaagtggggaaatgcagaagttgtggtgacgaacaacgatccggccgatttcacttctttgacagaggtgtttgatgttgtcttggcggatgtgccttgttccggtgaggggatgttccggaaggatcctgtggctgtagaggaatggagtacggacaatgtgcaggtttgttggcaacgtcagcgtaggattttagcggatatatggccggctttgaaacccggtggtctgctgatttatagtacctgcacttataatagggaagaggatgaggaaaatgtggcttggattgctgatgaattgggtgcggagatactgaaagtgccagtggcgtcggaatgggggataataggaaatttggcgggacaggattttcctgtttatcgttttttgcctcatagagtgaaaggagaaggatttttcttggctgtattgaggaagagtgctgccatttctcatgttgttccttgtattcgttgtcaggatgacaaagagaaaataacaaaaaagaagagaaaaggagaaaaggggagcttgtctcaggttgttccttttcccaaagaagtaaaaagttggttaaagcaggcggaggatttccgatttgaggtaagaggcacgaaggtgatagccttccccaatgtccatctttcagaatatgatctgttccgtcagaaattaaaagttgttcatgcgggtgttactataggtgagttgaaaggaaaagacgttataccggatcattcgttggcaatgagcacattgctgaatcatgatggtttctctcgttttgaattgacctatgaacaggctattgcttatttgcgtaaagaagcgatcacattggatgcttctgttccgcgtggttatatacttttgacttataaaaacattccattaggatttgccaagaacattggcaatcgggctaataacctctatccgcaggaatggcgtatccgaagcggttatttacccgaagaactttcttttgtatgctaaaaggagccatagatttgttcgggaagattgtgcatattgtttttcatagactggcgcaatgcttctccgggtacagacttgtttgtattctataatatacaaatttgtttggcttcgtacaaggaaaatgtgattatcagaaaggcttcctgtaggtacacccgtttttccattctgagcagccatacgcggtttttccttttataatcgttcctttgccacatagcgggcaggattttcccaccaattcgttatcggatgggatagtgggagcgggcgtggctgaagaagcgttttttcgtgaggtccctgccttttttttcggctgtttgaccgtagcggttgttgcagttttcgttgctgtttcctctattgtggtgacgcggcggtttgtattatcacttaaaacgctgtgtactatttcacttaccatttgctttaattcatttagaaaagtcgttgcatcatagcttttcttttctatttcacgtagtttcttttcccatattcccgttaattcggcggatttcaacagttcttcgcgaattagtcccaccagttctattccggtaggggttgcgatcagatttttacgttctttacggatataatggcgtttaaatagggtttcaataatggctgcacgtgtagacggacgtcctattccattttcttttaatgcatcgcgtagctcgtcattatctaccagcttaccggcagtttccatagcgcgtagtaaagttgcttctgtatatggccgtgggggttgtgtccatttctcgtccagtttgggcagatgcggcccgctttctcctttcacaaaagcgggcaaggagtgttcttcgtcattttcacgggcttctgcatcgggatcggtcataccttctggcagattggtttgtggtttggcaaagataacgcgccatccgggatctagaatctgttttcctgtggctttgaattctatactgtcagcttcgcctattacggtagtagtggcaaacttgcagtcgggatagaatacggcaataaagcggcgtgctaccaaatcaaatacccgtttctccatttctgtcagatttacaggaggttgtcccgtaggaataatggcatggtgatccgttacttttgaattgtcaaatacttttttggacttgatgagcttttgtcctgccaacggagcggtaaatactgtatatggagttagtcccgccaagatattggaacatttgggatagatgtcatcgcttaagaaagtagtatctacacgaggataagtagtcactttcttttcatacaatgactggataagttttagagtttcgtcagctgaataagcaaattttttgttacattccacctgtagggaagtcaggtcaaaaagacggggaggtgcttctgtgccttgtttttttgctacttctgtcacggtaaaaggaacatttttgatacgttccataagtgcctgtccggtagcaagatcggtgatgggaggaattcccctgttcccttcagcctttttggctttcttggggttctctttagcatcgctttcttcctgagccagttcctcatcgcttttgcggatgatggcagagaatgtggtttcccggtataaagtagccagtacccaatattgttgaggagtgaagttctctatttcttgctgacgctttactatcagtgccaaagtcggggtctgcacccgtcctatcgatagaatttgtctgttttgtccgtactttaaggtatagagccgggtggcgttcatgcccaatacccaatcaccgatagcacggcttaatccggcttcgtataaaggttggaattctttttgatcttttagtttgctgaatccttcgcgtatggcttcttcagtcaaggatgaaatccatagacgtttcaccgggcagtgtgctcctgctttctgcatgacccatcgttgaataagttctccttcctggccggcatcaccgcaatttataatttcatcggcattttgcatcagtccttctataatacgaaattgtttttcaatgcccggatcgctgattagcttaatgccgaaacgaggtggaatcataggaaggctggacagactccatgctttccatgagggagtgtattcatgaggctccttcaaagtacagaggtgtccgaatgtccaggtaacctgatatccgtttccttctatatatccgtcttttttggtttttgctcccagtacatccgctatgtcacgggctacggaaggtttttcggcaatacaaactatcatatttttttcgtttctgttcaaataggattgcaaaggtaataaaaacctcggaagagattttgttttgtctttattagttcttcttttataagaatttaaaagtaggtatcgggggctttaaggtcatttcagtgcaaatgggctgttaggtatggtttttctgttatttgctgtttggcgaatgtcttttgaacttttctctatgatttcagtttcttttcagaatcctataagaattttgcatcaaaaagaaactataaaacaatgtaattatgaaaaagaattggatgttatttttatttttcgcagcttttgctgcactaacttttagtggttgtagtgatgatgacaatagtgatgttcctgaaaacacacatttggtttcaaaagaagtacaggctgcatttaatgcaaaatatccgcaagccaaagacgtggaatgggagctgaaaggtgattatgctgtagcagatttttattgggatggtggagagcattctgcatggttcaatccgttatcggctgcctggtatatgacagaaacagatgttcgttatgaaaatcttcccgaacctgtacttgctgcccataaagcaggcaaatatgctgattggcgggtggatgatgtggataagttgactcgtgagggaatggaaactctttatgtcattgaggtggagaaaggagaatccgagctggatttgttttattcgtctacaggtatattggtaaaaactgttgtagataccggacacgaagaagattatgatgattatttgccgcagcctgatgcaaacggcattatagctattgtcaagcagaaatatcccaatgcgacaattgtagaaatagaacgtgaaaaaggtttgcaggaagttactattttagatgaaaacagagagaaagaggtttatttcaatgagcggaacgaatggatgggaacaagctgggatgtacaggtggcaaatttaccggaagcggtaaaaaaatcggttatggaaaaatattcagactatgtgatagatgatgctgattatgtggtgacacctgataatgaatggtatatacttgatttggaaaacaaacagatcgataaagagcttaaagtaaagatagataaggacggcgtttggttgtaattttattatcccctaggttatgctaggtaaacaggcggatgtttcatagggccggacagctttggggtttttaaacattatgatttttgtggcaggcagttgaagtgtgaatttgtatttctgttatacattttttgtgattttgatgagagagtaaaagatgaatgtggaaaaatagatttgtatgatatacgatattcagttacatttgcatttagaataaaaaaacagcatgatggaaacaggattaacttatacttcgactgttgtcgtttcaaaagaaaatgtagctgccaccatgggtagcggcgatttgaatgtgtttgccactcccgctatggtggcgttgatggagaatgctgccatgagtgccgtggcagatgagttgcctgaaggttctactacagtaggggccatgatgaacactactcatatcaagccctcggctgtgggagacacggtttcggctactgccgtattaaaagaggtggaaggcagaaaacttacttttgaagtgcgggcgcaagatagcaagggcgtgattggagaaggtacacatgtacgttatattgtggacaaagagaagtttatgagtaaattgtcttaataattatttgaaattatgccacaactgagagcttcccttcttttgtgattctgaatattatttgttccgataacgggaaatcaagtagaggaatgaagaacgtgctttaataaaaaatatttaaggagagcaaaatgaatgacaatctgaaaaagagtgtcatggagttctgccctccttcttttattcttgcagcgccaagatatattcgtataacttcttataaaacggatgtttcgtcagcgtagaggcatctcctaatataataagtttcatgcgtgcacgtgtaattgctacattcattcgtcgcaagtcatttagaaaaccaatctgtccctcttcatttgcacgtactaaactgatgaggataacgtctcgttcctgtccctgaaaaccatctaccgtattgatggtgataaggtgtcggtaaggcttgaagaaagcatctcgttttatcagttgacggagatattgtacttgtgctttataaggagaaatcagtcccacatcaatccgttcttccagaaaacggtctttacctattttattgatatagttggtgagttgggaaatggagagtgccgcctcctctttattgatacggccgaagctttcacccacaaactcttcgttgcattccattccttccgtatttatccattctatcggtgtgtcatagtccaatatactccgatattttacttcgggagctgatttcagttcaccctgatagaaccattctgaagagaaacgcataatttcgtcattcattctatattgtacctttaacaaggatacagtgtcgggtttgttgtctgcaatctcctgcatcagtgtccggtctaatcctccacgagctgcttccatgcatttaatggtaggaggaagctggcaataatcaccggccagaatgacacggtctgctttgcggatggcaatccagcaggcaggttctagagcttgtgcggcttcgtctatgaataaggtactgaatttgcgtcctgtcaatattcggttggcggaacttaccagtgtgcaggctatcacacgtgcttcgccgaacaatgcttcgttgatgcgaatttccagttcggtggcacggtctttcagtgagtttattttctgtcggatattctcacgttccgctcctttgcgcgaacgtccgtagagctcgcgtattgcttttcggatactccataattgcggataatcgggatggctttcaaaacggcgttcataggtaaaagcaagcattttgtcattgacgcggatgggattaccaatacggagaacgggaacaccccggtccaccagtttctcgctaatccagtctacagccatattgctctgtgcacacaccatgacttgattttcccggtgaagggtctcgtaaatggcttctaccaatgtggtagttttaccggttccgggcggaccgtggactatagcaacatctttggcatgcatcactttatttactgcttcctcctgcgtattgtttaaccaggggaaacgggtgaagccgaaactgaaagtttccgccttttggttgccatgaaaaatctcacgtaactctgccagacgattcccttttgccttgaggacttgtcccaacgcttcgaacatcaaccggtaactggtttcatcaaaataaagctgtactcccaattgtcgctcggttgcctgtatgctgagcaatgcatctgccgaggggagaacgattaccattcggtcttcgtccacgtagttgacagttgccgtaaaattgaaataatgtaattggcctgatgcattttgcgtaaaaaagcataccggacggccgaattcaaatacatgttctatgtctttgtcttcttgcctttcaacttctacaaccaattgattcaatgagttataatagcttctgcctgccgatataggataccagcacataccccgtttcactttgcgcccgatgcccatagcttcagtctgttgcctgaaagtctctttttcgtaatcatattctaattttagtaacaactctttgcgttgtagtttgttaattatattagaaaggggtatatgttggttcataatgatgcttttttctataagaattgcaaagataataataatcctttaggtaggactttatgttttattttgttaaacgtattatagattacacaagaattcaaatattattcctatattgccaaaaataaaatagatttaaaactgtaataattataaatggtaaaaggtatggtatatgacttggacatgttaaaggccttttatgcttctttcgaaaagaagataggtcgggtaagagccgtgttgcagcgtccgctgacattggctgagaaaattctgtatacacatctttatgatgatgctcaactgaagaattatgaacgtggcgaggactatgtgaatttccgtcccgaccgcgtggctatgcaagacgcgacggcgcaaatggcattgttgcaatttatcaatgcaggaaaggattccgctgccgtaccttctactgtgcattgtgaccatttgattcaggcatataaaggagcgggcccggatattgcaacggctacggaaaccaaccgtgaggtatacgatttcttacgagatgtttcttcgcgtttcggtatcgggttttggaaaccgggagcaggaatcattcatcaggtggtactcgaaaactatgcttttcccgggggaatgatggtggggacggattctcatacccccaatgccggaggattggggatggtggcaatcggagtcggtggtgccgatgctgtggatgtaatgaccggtatggaatgggagttaaagatgccgaaactgattggagttcatttgaccggaagcttgaatggatgggcttcgccaaaggatgtgattctgaaattggccggtattctgaccgtgaaaggtggaacgaatgccattatagaatattttggagaagggacagcttcactttcggcaaccggtaaggctactatctgcaatatgggtgcagaggtgggggctaccacatccttgttcccctatgacgaccggatggctgtgtatctgaaagctaccggaagagagtctgtagcagagatggccggaaaagtggcaaatgatttacgtgccgatgctgaggttgttgccaatccttctgctttctacgaccgtgtgattgaaattaatttgtccgagttggaaccttatatcaacgggccgtttacaccggatgccgcaacacctatttcagagtttgccgaaaaggtattggttaatggttatccgcgtaagatggaagtcgggctgataggttcatgtaccaattcatcttatcaggatttaagtcgggctgcttccattgcccgtcaggtagctgaaaaacatttggctgtggctgctcctttgattgtcaatccgggttctgaacagattcgagctaccgccgagcgtgacgggatgattgatgctttccaaaagattggggctactattatggcgaatgcttgcggtccgtgcatcggacagtggaaacgccataccgatgatcctgtccgcaaaaactcgattgtcacttctttcaaccgtaattttgccaaacgtgccgatggtaatccgaatacacatgcatttgtggcttctcctgaattggtattggctctgactattgccggtgatttatgtttcaatccgttgaaagatacgttgataaatcaagaaggcgagaaggtgaaattgagcgttcccgagggagatgaattgccgtcggcaggtttcactcaaggtaatcccggttatttggctcctgccggtgcacaggtagaaattaaggtgaatcccgaatcacagcgtttgcagttattggctccgtttccggcatgggatggaaaggattttacggatatgcctttactgattaaggctcaaggtaaatgtaccacagaccatatttcgatggcaggcccgtggctgcgtttccgtggtcatctggaaaatatttcggataatatgctgatgggggcggtgaacgctttcaatggtgaaacgaacaaggtgtggaaccgattgacaaatacctatgagagtgtatcgggcgcggctaagcagtataaagcgcaaggcatcgggtctatggtagttgcggaggaaaattatggagaaggttccagtcgtgaacatgccgctatggagcctcgtttcctgaatgtaaaggttattctggcgaagagttttgcccgcatccatgaaacgaatctgaagaagcagggaatgttggcggtgacttttatagacaaagcggactatgacaagattcaagaacatgatttgattaccgtcagcggattggcggactttgctcccggaagaaatctgactgtgactttacaccatgaagatggcactcaggatggttttgaagtacagcatacttataatgaacagcagataggttggttccgtgccggctctgctttaaatgcaagataaaagatgaaaaagacagtaccttatattacaggagacggagtgggagcagaaattactcccgctatgcaagccatagtgaatgcggccgtgaagaaggcgtatggcaatgaacatgaaatagaatggatggaagtactggcaggtgaacgtgctttcaacgaaacaggttcctggttgccggatgagacgatggaggctttcaagaaatatggtgtgggcataaaaggtccgttgactactcccgtaggaggtggtatccgttccttgaatgtggctttgcgccagacgctggatctgtatgtgtgtctgcgccccgtacgttggttcagcggagtggtatctccggtgaaagagcctcagaaggtggatatgcatattttccgcgaaaatacggaggatatttatgcaggtatagaatgggaagcaggcacgccggaagctgagaagttttatcgttttttgcatgatgaaatgggagtggctaaagtgcgctttcccgaatcttcttcatttggcgtgaaaccggtgtccaaagaaggaacggaacgtctggtacgtgcggcatgtaaatatgctttggagcatggcttgccgtcagtgacgttggtgcataaaggaaatatcatgaagtttactgaaggcggcttcaagaaatggggatatgaactggcggaacgtgaattcggagatgccattgcgtcaggcaagttggtgataaaagactgcatagccgatgcattcttgcagaatacgttattgattcccgaagaatattcggtggtggctaccttgaatttgaacggagattacatctcggatcagttggctgccatggtaggcggtatcggaattgctcccggagcgaacatcaattacaataccggtcatgccatttttgaagcaactcacggtacggctcccaatattgccggaaaggatgtggtgaatccttgttcattaatcctctcggctgtcatgatgttggaacattttggctggaataaggcggcggagctgatagtgaatgccttggaatccagttttggcgagggacgtgccacacatgaccttgcccgttttatgcccggaggtgtctcgcttggcacgtcggcatttacaaaagaaataatagaaagaataaactcctaaaaactcacggatatgaagaaagaatatatcatttacaaactctccgaggatatgaagaatgcaacccggattgagaacgaattgttcaagaagtttgatgtaaagcgcggattgcgtaacgaagatggcaccggtgttttggtagggttgaccaagataggcaatgtagtagggtatgaacgtattcccggtggaggattgaagccgattcccggcaaacttttctatcgtgggtatgatttggaagatttggcacatagtatcattaaggagaaacgttttggttttgaggaggtggcttatctgttattgtccggtcatttgcctgacaaggaagagttggcgtctttctgtgagttgattaatgacaatactccgttggaacagaagaccaaaatgaatatcattgagttggagggaaataacattatgaacattctggcccgtagcgtgcttgaaatgtaccgttttgacccgcaggcggatgatacttcgcgtgataacctgatgcgtcagagtattgacttgatatccaaattcccgaccattattgcatacgcttataacatgttgcgccatgccacgtatggtcgttcgttgcatatccgtcatccgcgtgaaaaactgtctatcgcagaaaacttcctgtatatgttgaaaaaggattatacggaacttgatgcgcgcacgcttgatttgctgttggtacttcaggctgaacacggaggtggtaataactctacttttaccgtccgtgtagtttcgtccagccgtacggatacttattcggccatcgccgcaggtatcggctcgttgaaaggtccgcttcatggaggggcaaatatccaggtggcggatatgttccatcatttgcaggaaaatatcaaggattggaccaatgtggacgaaattgatacttactttacccgtatgttgaataaggaagcgtatgataagtccggtctgatttatggtatcggtcatgcggtctatacgatatccgatcctcgtgccatcttgttgaaagaattggctcgtgatttggcaaaagaaaaaggcaaggaagaagaatttgctttcctggaattgttggaagaacgtgccatcgctatgttcggaaagattaagaataacggcaagacggtgtccagtaatatcgatttctattcaggtttcgtatatgaaatgattggtctgccacaggaaatatttacacctttgtttgcgatggctcgtatcgtggggtggtgcgcacaccgcaatgaggagctgaattttgaaggaaaacgcattattcgtccggcatacaagaatgtgttggaagaactggaatatgtgcctttgaaacagagataacggtttagaggcacctcggttggcgataagctttggtattattgttttagcttggcggcaatgaggtctgtattgttgtaaagaaaagtaagatatcttcgtggacaaagtaagatatgtttccgagcaaagtaacaccacgtacatgttccacgaagatatcttacttttttcagtgagatatggtcgttcataatactctatatagagtaccttgaaaaatccttcaaatctttcagcctgctcgcaaatgccctgcccgtcggcttttcggctgaagaattgggctcgggaatccttcagccgggattggaatccttcagccggaccggtgttcttccagttcttagggaattggtttttctgaaggatattttccggctgaaacatttcacaatgcatatccttcagccggaatgccgacgggcagggcgtttgcgagcaggctgaaagatctgaaggaaaaataaggcgtttcggcatgtagatgccgttatgggaaaaaacaacaggtcaaattttaaaaagctcttgttctttcaatgaaaacgtcttgttcttttctgaaaagaacaaggcctttaaaaaaaagaacaagacgtttgaaaggttagtaacgtgtatgccggaaggttaataacgtgtgggatgatacgttactattgaatattttacaattataattcattatattgcatactatacatatcaaaaccgtcagcccaataattgcgtttgatttcattcagtgtgaatccttgcttttcatagaatttatatgctaattgcgaggttcggactgttatttttttgatactgggaatagcctttaaaacctcaattctgtatcttaaaagctttttacctaaagatttgccttgatagtcgggatgcataatatcccaacttatttttccaatggttcttttttctgcgaaatttatcccgccgcatccaaccactttcccgtcaacgagcaagacataatagagctctatttctttatccaaataattgctcaaatcattaacttcctcttttgcaaagaagttgggtgtgtttaatttaattaaattcatgacaacttctttatctgtcgtcaaatattctctaattacaattgaattatcttgtgtcatagaactttcgtttgaaattcgtggcaaagatacgaaaattaaaaactgacaagagatcaaaatattgtctattgaaaaaatagtaaataattatttgacagcatagcaccacaaattattgaaatttgcacagttgctgaatcgttacctctgttccttaaatattacgctaaacatttgttttttcaattggttaatccaagatgatgaaaatctaaaataaactgctcttaatataattttgaaatatcttatcccaactctttttctgtgtctaagtctgggtacaataaaaaagcatgtccagtttgctaatggcgttacgagcttcctgtatatgtctgatgctgaaatgcaacgtgatggtactttgatgattggcgggggagggaagtcggaaatcaatggaaaacctgtagaaaatagtatatacctctctaagtaaagtcttctctgcgataaaaatcgtatcctttttttgcaaaaaatctcttaattgttgctttcctctgatttttcccttaaatttgttagtgacttactaaatttaatacagggaggaacgagtatgggacaacagacttttgaatttttgctattggcaatgtccgcacttgcggtgattgtatttgtagccctctattatgtacgtgccggttatggtatgttccacaccccgaaatggggactttcagtgaacaataaattaggttgggtactgatggaagcgcctgtattccttgtaatgctttatctgtggtggaacagcagcgtgcgttttgatgccgctcctttcctcttttttcttctttttgaattacattatttccagcgctcttttatcttccctttcctgatgaaaggaaagagccggatgccccttgccattatgttgatgggagtggtctttaatgtcctgaacggactgatgcagggcgaatggttgttctatctggctccggaaggactctatacagatgcctggctcagtactccttctttttggcttggggttattctgttctttatagggatgggcattaatctacattccgacagtgtgatccgccatttacgtaaaccgggcgatacacgccattatttgccgcagaagggaatgtaccgatatgtcacttcgggcaactattttggcgagttggtggaatggatagggtttgccgtactcacttgttcgcccgctgcatgggtgtttgtgctgtggacgtttgctaatctggctccacgtgccaattccatccgtaaccgttatcgggaagagtttggtaaggatgcggtaggaaaaaagaaaagaatgattccttttatttattgaatttgaatagtatatcgtttctgtttcaggaaatgatgaaagcgaaacataacatatgaatgatgaactctaaattatttactcccgcttctatcggaccgctgactttgcgtaaccgtacgattcgttcggctgcttttgagagtatgtgtccgggcaatgctccgtcccggcaattgaaggattatcactgctcggtggcggcaggtggagtgggaatgactactattgcttatgcagcagttacacagagtggcctttctttcgacaggcaattgtggatgcgccctgaaattataccgggattaagggaaataaccgatgcggttcataaagaaggggctgccgtaagcattcagttgggacattgtggaaatatgtcgcacaaaagtatttgtggggtaacacccataggagcttcttccggttttaatctttattcgcctactttcgtgcgtggcttgcgcaaggaggaactgccgcagatggcaaaggcatacggtcagtcggtcaactgggcgcgtgaggccggatttgacgcggtggagatacatgcggggcatggctatcttatcagtcagtttctttcaccttacaccaatcatcgtaaagacgagttcggcggctcgttggagaatcgtatgcgctttatggatatggtgatggaggaagtgatgcgtgccgcaggtaatgacatggccgttctggtaaaaaccaatatgcgtgacggttttaaaggaggaatggaaatagatgaagctgtgcaggtagcgaaacggttggtacaggacggggctcatgcgttggtgctgagtggaggttttgtaagcaaagcgcctatgtatgtcatgcggggagcgatgcctataaaaagtatgacacattatatgaactgttggtggctgaaatatggggtgcgtatggtaggcaaatggatgattccgacagtacctttcaaagaggcttattttttggaagatgcattgagattcagaacagaaataaaggaaattccgttagtatatgtgggggggctggtatctcgtgaaaagatagatgaggtattggatgatggttttgaatttgtacagatgggaagggcgttgctgaatgaacctggttttgtgaatcggttgcgcactgaagaaaaggcgcgttgcaattgcggtcatagtaattattgcattgcgagaatgtacactattgatatggcatgccacaaacatttggaagagaaattgcccctttgcttggaacgtgaaatagaaaaattagagaaccaatgagtaaattagccataataaccggtgccgatggaggaatgggaaccgaaataacccgtgcggtagcacaggccggttatcatgtaattatgttgtgctacactcttttcaaaggagaggagcgtaagaaccagttgattttggaaacaggcaataaagagatagaagtcagacaggttgacctttcttctatggcttctgtgactaatatcgcagaagatttgttggggcgtggaaaacatatcgacttactgatgaacaatgcgggaaccatgagttccggaggtttgattacaacggaggatggtttggaatatacggtagccgtgaactatgtggccccttttttactgaccttgaaattattacctctgatggggcagggaacccggattgtgaacatggtttcttgtacgtattccatagggaagattactcctgaattttttgttcgtggaaagagaggaagtttttggcgtatccctgtttacagcaatacaaagttggctttgtggctttttacccgtgaactttctgaaaggctgaaagcagagggaatcaccgtcaatgctgccgatcccggtattgtttctaccaatatcatccgtatggatatgtggtttgatccgttgaccgacatactgttccgtccttgtatccgtactccgaagcaaggagctgcgacagctgtcagtttgcttttggatgagcgatggaaagaagttacaggacagatgtttgcttcttgcaagcctaaaaaagtaaaggataagtttatgaatcatccgcaggcaagacagctttgggcggatacgaaagcatatttggagaaactgaaattggaggagccaattggctgagaattcctttaaatacataaaagccgtatcgttactcaaaagtagagtggatacggcttttatggtcggtgaagagtgtctggtttcggattgcagtgtagttgaggttattctttcttggctgcttgttctgccagcatctgttcacggcttttactttgggttacaatataaactcccgtgaataccagtgccacagctattcctttggcaacaccgaaggttcccattcctaacaagatagagacactggttcctacaataggctgcacatagttgtacatactgatgacagtagggcgcaatgttttctgtccgatcatcatcagaatataggcaaggaatgttccacctacaatgacataggctacacaggtccatgtggaagtggaaatttcgtgaaaatgtatggtcgagacctcatgataggaaaatggaataaagcagatggctgcataggtgaacatccatttcattaaagtaaatatgttgtatctgctgatcagtcctttgaaaatagccagatagaatgagaaactgatttgtgccaacaggcaaagcaaatctcccggaatacttccgccttttccatctgttgagccttggctgctcagtatgagtgttaaagctccgatggaacctagaaaaatgccaatcacttttttccctgtaaccggttctttcagataaatggcagcgacaatcatagtggcgataggggctgtggttgttacaatggaagcatcgatgggggaagtcagtgatagtccgaaagtaaaacatccctgattcaggacgatacccaacaatcctgcaaagaacaacatcatcaagtcgtgcggctttacttgttctttaggagcgaaaatagaagctatccaaaaacagatagcacctcctgtcattcgaaatgtagcgagggaaaggcctgaaataccgttttctaacgccgttttaccaattggggacattaatccccacattatggcagcgcctagcaatgccaaatgtcctttgtacttttgaatagccattctttttaccttaaataacagtgcaaatgtaggaggttttttttatattttctatctttgcttacaagtaaatctatcaaaaatgaaaaagcaagctgattatataaaacgtatcgagataaagcggctttggggccgtaaagatatctcatgggaactgcgtccggatgtcaatattctgagcggagtgaatggtatcggcaagagcactatcctgaacagatctgtgaatagcctgacggctttggaaggtggagcgttgagtaacggttcggctcccggtgtacattttgtcttctctccggaagatgctacccagatacactttgatgtaatccgtagttttgaccgtccgttgattcattcggaacttctcgaaaagatggcggataagaatgttaagacagaattggattggcaactttatcagttgcaacggcgttatctggattatcaggtaaatatcggtaaccgcatcatcgagtgccttacctccggtggccctgacggtcagcttcgtgccgccgagatgtcttaccccaagacaaaattccagaatctgatggatgacttgtttggtgagaccggtaagaaaatcattcgtaaaagcaatgagattttgtttgaacaggatggagatatactttatccttatcaactgtcttccggcgagaagcagattttggttattttgctgacggttctggtgcaagacaatcgccgcggggttttgtttatggatgagcctgaagtatccttgcatgtggaatggcaacaacgccttatttcattgatacggcaattgaatcctaatgtacagattgtattgacaactcattcgcctgctgtgattatggatggctggctggatgcagtgaccgaggtgagtgatattacaaaataaacaatttctaacgacgatactatgggaaaaagattgtccgagaatctgtcctccttatatattggtgcggccaacaaattgaagcctaaatgttcgcgacgcaagattattgcatacgttgagagttatgatgatatttcattctggcgtaccttgttaggtgaatacgaaaatgaaactcgttatttcgaagtgatgcttccttcgaaaaccactttggctaaaggtaagaagtctgtgctgatgaatgaactgggacctcggttgggacaaaatatgatagcttgtgtagatagtgattatgattatctgttgcagggggctacccatacctcacgttatataataaataacaaatatgtttttcatacctatgcatatgctatagaaaactatcagtgttatgctgaagcattgcatgaggtttgtgtcatggcaacgttgaatgatcatccattggtggattttgtcgcttttatgcgtatgtattctcaaatagcttatccgttgttcatctggtcggtgtggttttatagaaaacataatctttccgaattctctttgcttgatttctgttcgtatgtaaaattagatagggtcagtgtctatcatcttgaacggagtttagagagtatgagccgcagggtgaggcgtaaattattggagctggaacgccgccatccgaaagccttggaggaaatagaggcgatgaagggggaatttgccaaattgggagtgaatgaggacaatacctatatgtttattcaaggacatcacattatggatagtgtagtgatgagattgttagtacctgtctgcaatgtgttacgccgtgaacgtgaaacggagattaaagaactggcagagcataatatgcagtttcataatgaactgaccagctatcagcgccggcagttgggagtagacattgtactccgcaaacataccagctataagttatcacctctttataaaaaattggaagcagatatagaacgtttcttgaaacatatctgaatcggttatttcttatgggaggcaagtgctttggctatgaaatgatctagtgagaatttacccggtcctgctatatacaataatatgaatactaccagataaataaaggctaattctttaacggcgaaaggatcagaaccatgaacaacaaagaatgcgatacacatggtgaagatcatcggaagcattgccaagcgataaaggaatccgaaaatgaaagccatcgaacaaaccatttcaccaaaaatagccagtaccagtgaaagttggctgcctattcctaaaggatcgggaaaactgccggacatgacatcgtagttggcccatttctgtacaccgtgcgacatgagtaaaataccaaacaggattcgtaaagctaatatcagaagtgacatagcagtgccatcgggcttggatggaaataagaatttataaatgactgacataatacgtttttatttttttgtttatactatatttatataaacgtaacaaaagggtgaaatgttcaaatcattcactgtttgtttctttggagatggttgattcgctcatattaattttttattgtagaaaaactcttgaaacgaatgtcaggacttcgtgcaaaaggaataaaaaaagaacaattataataaatattagttctatatggtataatgtttgtcgtaccttaggtaacgataaaagctaacatacgaatatatgaaaacaattaaatgtattggagtgctgacatccggaggggatgcttctggcatgaatgccgctatccgtgcggtaacccggagtgcaatttgtaacggatttaaagtgaagggtatttatagaggatatgaagggctgattaatggagaagtgaaggaactgaccacccaggatgtgagcagtgttattcaacgtggaggaacgatgttgaagacagcccgttctgctgaattccaaacagtagaaggacgcaagaaagcatacgatactatgcagcgagaaggaattgatgctttggtgattataggtggaaatggttctattacaggagcccggatttttgcggaagaatatgatgtgccttgtatcgggttacctggtacaatagataatgatctttatggtactgactttaccataggttacgatacggctttaaatacgattgtggaatgtgtggataaaatccgtgatacggcaacctctcacgaccgtatattctttgtggaagtgatgggacgtgatgccggttttctggctcaaaacagtgccattgcttctggtgctgaggcagcgattattcctgaagatcgtacggatgtggatcaattggagaaatttatcgggcgcggttttcgtaagacaaagaatagcagtattgttattgtttccgagagtccgaaagacggaggtgccatgcattatgcagagcgtgtcaagaaagaatatcctcaatatgatgtgcgtgttaccattttagggcatttgcaacgtggaggttcgcctagtgcttatgaccgtattcttgccagccgtctgggggcgggagctattgatgccatattggaagggcagcgcaacgtgatgattggcattcataacgatgaggtggtatatgtacctttttctgaggcaattaaaaaagacaagccccttgataaatcgcttatcaaggtgcttgatgaattatctatttaatgaaaataatcatgaaaggagaagcggaagtaattcttctgctttttctatgatatgtgccggatgtaaggcttccaattctgtgcgcggccggaatccccatgccacacctatagctgttactccggcatgatgcgctgtttgcatatctacattagaatcacctacataaagtatatcttcctgtttgactcctgcttttgtcatgatttcgtttatgatggatggatcgggttttgcggggataccttcgcgttgtcccagtacttccacaaagtttatttctggaaaatagtgtgctattaactttcgggtagctgcttggtatttattggaggcgaccgctatcatgatcccttgctgttgcagtgtttttaataattcggagataccgggataagggcggcttaaatcggcattgtgctcatcataataagggatgaattgtgaacgtatctttaatacattctcttccgtacgttccccttcaggcagagcacgctcaaataatttattgattccgtttcctacaaaaaagcggtatgcttccgtttcatgtgtaggatagccataatattgtaaggcttggttggtggcggcagccaggtcggcaatggtgttcagtaatgtgccgtccaggtcgaatattacaagtttcttcatatttgtacttcttttatcggtgcaaagttactatttttgtatgcaaactaataataatgcttatgaactttctagaattagtgaaggcgcgctattctgcacgcaaatatgccaatcgtcctgttgaggctgaaaagttggattatatcatggaatgtgtacgttttgcaccatctgcagttaattttcaaccatggcgtttccgtattgttacagatgaggccgtactgaaaacgttgtattcatgttataaacgggaatggcttgctacggctccttgtatcatagtggcttgtgtggatcataatgagtcttggcatcgccgtgccgataataaggatcatgctgatattgatattgctattgcagtagaacatctttgtctggctgctgccgaacaaggactgggtacttgttgggtttgtaattttgatgctccgcaatgcagtgaggttttgggactgccggaaaatttggaaccggccgttttgattccggtcggttatgcggaggatgaacctacagaaaagaagcggaaaccattaaatgaaatccttctttaaaaaatcacaaaaccacctttcggagtgtcatcgggcaggtagattcaatttccttttacagtggatgaaggtactgttaatttcttgacctgatgactgttccggattttaagcacatttctttagactcttcttattttctgataattttgcatattttgtattccatttatgatagaagtaaagccgaaatggctaaatttgagcactttttaggctttgaataacctatgagtgtagtaagtactattaataacactgaaaattatggagaacataggagttggattgatgttgatggtggtcggtatggcgaccgtctttgtcattctcctcatcgttatctatctaagcaagtaccttattactgttgtcaacaaagtggcccccgaagagacccccaaaaaagcacctgctgtagcacctacggcagatactggtgctatggatgctattaaggcggcagttgagattttgacagcaggtaaaggtcaggtgataaagattgagaagttataatccaaaaaaagaaaaacacatttatcaaaaatggaaagagaagtaaaatttagtctggtcttccgcgatatgtggcagagtgcgggtaagtacgtgcctcgtgtagaccagttggttaaggttgccccggctattattgaaatgggctgtttcgcccgtgtggaaacaaatggtggtggttttgaacaggtaaatttattgtttggtgaaaatccgaatagagctgtgcgcgagtggacgaaacccttccacgaagcaggcatccagactcatatgctggaccgtgcgctgaacggtctccgcatgagtcccgtcccggcagatgtccgtaaattattctataaggttaaacatgcgcaaggaacagatattacccgtactttctgcggattgaatgatgtccgcaatattatcccttctatcggctatgctcacgaagccggaatgatttcacaatgttcgctctgtatcactttttctccgatacatactgtggaatattatgtgaatatggccaggcagcttatagaagccggagccgatgaaatctgtattaaagatatggccggcatcggacgtcccgtttcattgggaaagattgttgccggaatcaagaagattaaaaatattcctatacagtatcactctcatgcggggcccggattcaatatggcttctattttggaagtatgccaggctggttgcgactatattgatgtaggtatggaaccattgtcatggggaaccggccatgctgatttgattagtgtgcaagccatgttgaaagatgccggatttaaagtgcccgaaattaatatggaagcgtatatgaaagtgcgttccatgattcaggagtttatggatgatttccttggtttatatatcagtcccaaaaaccgtctgatgaattctttactgattgctccgggattgccgggcggcatgatgggaagtttgatggccgatcttgaaacgaatctggaatctatcaacaagtacaaggcaaaacgtaacctgccgtttatgactcaggatgaattgttgatcaagctgttcaatgaagttgcttacgtatggccgcgtgtgggttatcctcctttggttactccgttcagccagtatgtgaagaaccttgccatgatgaatgtaatggctatggagaaaggtaaggaacgttggggaatgattgccgatgatatttgggatatgattttgggtaaagcgggacgtttaccgggtaaactggcccctgaaattattgaaaaggcagaacgtgaaggccgcaagttctttgatggcaatccgcaggacaattatcccgaccagttggaaaaatatcgcaagatgatgcttgaaaaacaatgggataaaggacaggatgacgaagaactgtttgagtatgccatgcatccggcccagtatgaagcttataagagcgggaaggcaaaagaagacttcttggcagatgtgaagaaacgtcgtgaggagaaagcgaatgccactactcctgtcgaagctgaaaacaagaccaaggtattgacggtggatgtgaacgggcaaccttatcgcgttacagtggcatatggtgctgtagatcctgctacgctgacagctccttcgggtgcagttcctgcacaagctgctcctgctccagtaggggaagggaaagatgtgctttctccgttggaaggtaaattcttcttggtaaagaatgcccaggaaactccgaagaaggtgggtgaaaaggttaataaaggtgatgtgatttgttacgtcgaagcaatgaagacctataatgcgattcgtgcggaatatgacggtactataactgctatttgcgctaattcgggtgacacggtttcagaggatgacgtattaatgaaaatagtataatggaagatatatttgaaagactttatgatatgactgctttcagcaatattattgctgaaccgcaattcttgataatgtatgccattgcgttcatcttactttacttggggatcaagaaaaagtacgaaccgctgctgctgattccgatagctttcggagtgttgctggctaactttcccggtggtgagatgggggttgtccaggccgatgagaacggcatggtaatggtgaatggagcactgaagaacatctgggaaatgccgttgcacgaaattgcgcacgacttgggcctgatgaactttatctactacatgttgattaagaccggttttcttccgcctatcatttttatgggggtaggtgctttgacagactttggtccgatgttgcgtaatttgcggctttctattttcggagctgctgcacagttgggtattttcacagtattgttggtagctatcttgatggggttcactccgaaagaggcggcttcattgggtattattggtggagcagacggtcctaccgctatctttaccactattaaactggctccccatttgctagggccgattgctattgccgcttattcgtatatggctctggtacccgttatcattccgttggttgtgaaaatctggtgtacgaagaaagaattgagtatcaatatgaaggaacaggaaaagaaatatccttcttcggtagaaatcaagaatcttcgtgtgctgaagattgtatttccgattgtagtgactacggtggtcgctctgtttgtgccaagtgcagtgcctttgattggtatgttgatgtttggtaacttgattaaggaaataggtagtgatacttcacgtttgtttgatgcagcttcaaatagtatcatgaatgcggcaactatcttcttggggttgtcagtcggtgcgacaatgactacggaggcatttttgaattggactactatcggtattgtgataggtggtttcttggcgtttgccttgtctatttccggtggtatcttgtttgtgaagttggtgaatcttttcactaagaagaagatcaatccactgattggggctacaggtttgagtgctgtgcccatggccagccgtgtggctaatgaaattgctttgaagtatgaccccaaaaatcatgtgcttcaatattgtatggcaagtaacatttcaggagttatcggttctgccgtggctgccggtgtgctgatttcattcctacaataaaaatcatcgtatttaaattgttcgggcacgaattatacggaaattacaggtgttttagacaatactgtaagatctgtatagttcgtgtcttttattctctttctgtatcgttctcctggctaaaacaatagaataggccctctcctcacgaagaaagcctatcgttagattaatgtttaatataagagagagttttatagtcctaacagttcattgaacttctctgctgtcttgggatctgacggacgggtcatattggcagagatgattttgccatcccgatccagcaggataaaacggggaatgccgttgatgaggtaagcatccataaaggtcctgtctgttcccatgtgtaactggatccctttcagttgatcctttgttaccatgttctcccatgcctttttgttcttgtcgcatgacaggctgacaaaatgaatatcctttcctgcatatttctcttccaattcctttaacgcaggaagttctccacggcaagggccacaccaggtagcccacacgtcaatatagatatatttccctttcaaatctgccaaagatactgttttcccatttatatccggataggagaagctagctgctgagggattgcctgatcttaatttttcccacttggtacaaagtgcgttgaatttttctatggactttgcatccttcacatgtttgcggaataggacaatcagcccgtctgcttcatccagcccgttattgtctacaaagttataaacaaattggtcaatcagaaattctgcaaccttttcatcttgtatggttgcatctacgtagtttacactttgttctgtagaattggatgcaactgtttttcctttattactaaaggcgctgatagcatcgggaagaaaagccttatattcttttagagctaataaaccggcattgatcggagtaatagcttccagtttttcataatatgctttggaaggaatatagttgtcatcctttccaaaatgaggatgatacaaagcgtatttggagaaataataatacgtatagaattgcaaacgtattttttcctgtgcagtgaaatcggctggaagttttgcggcttccaatacttggcaattggctgcgtacaggctgtctcctttgtgtatgagggcggcctcttgcattttcatatcgggcataccgagtgattggagctctttgcttcccagataggtgttgatagcggcacctgctccttcaaaggttgtgtttctccacatgttgtcactgtcgaatgacaaggtaaggtcttgattgggatccagataaagagtacggcgtccgcgtgtgtattgcatggttacatattgcggagtgaatcctgtgatttctatgttgccgtttccagcggcatcaatcgccacttctttttgttcgccactttggctgaaagtcaatctcactttgaccttctcattgggattggtgaccttaaaagtgagctttgcagcttctgtagcggtaaaggtactcagcgcaaggccaagtaccatgatggattttagagttctcatcttatttttttcttttaggtttcattttcaatgcatcgggacgcatgttatagactttttttccgtatgcggattctgtgctgaggcaggcagggatgggggctttgccgttcagtttgcgaagcaccatttccaaggcggctgcatattcctgatggatgaaagcatcatctctgtctgtttggttataagcaatgtattgcagatagcctacacatttgttgaaccagaattcgggaagttcctctgctttgtatcccaaacgggcgataaatttcagtctactgattaactcttgctgattgactgtggtgtctgcaatcatcgcatcaatctgggtagctgccgcttcatacttttgttcccggatatcattattgatacggatcattttcagattgaaatcttttccttcatagttgcataaggcttcaatttccgccaattcgccgtatgaagtttcttttgccaatttagcatcaacagcttttttgccgaaacgctggcagaaatctgcataattgtctgatacttgcttcaggtacgggttcatgccattgatagtgtttacatatacttcccatacatccggatcagtcagtttggcacctccttttattaattcatcaaaagcggcttgtacgttattgcgtgcatagactgaatagtgataattgatgtaatcaatcaggaatgcacgttctctgttccccttggtatattgctcttgcaggtaaaaagagcgtttggtaggaatgtttgcatcttttcctgtctgaataaactgttcgggagtctgacggctgctgctgcgatgaacaatttcttcggtagcaggatcgacgaaggcataagtagggtagctgcgtacaccgtatttcttggctaatgtaattccttcaccttcttcagcatcaattttgaggttgatgaaagtttggttatagtagtaacccactgtaggcaatgagaatacagtttgtgccatattcatgcaaggtccacaccattgggtatagaaatcaatgaatatcaatttgttttctgctttggctttagctacggcttctgcccaagtagtgccgtgcaggaaattgattcctgcattctgggcatttaagtgaatcgcatagatacatgcgaaaatgagtaagatatattttttcatgtctttgaatttaatatgttaataaccagggttttgtttacattccagattagaactgatttctgatgacggaatggcatcgatacggcggtctatgatgcgttggtaataattgtctccttgtgcttccgatttttcatattctttttccaaagcttctcttaacgtcttgttcaaagcaagcagacgggtgaaatcgggtttctctgtgtatcctgcaaaacggatcatggcaaaccattcatgccagttctcgaaagacaattccagcatccattcgttgaatatggcggtttccagttcttcgttattggctggaagaattatttcggctcctgctctttcgcgtagtttacggatcggtgcgtaggcttcggatatagaggctcctgaacgatacaaggcttcggctttaatcaggtagagttcggaaacacgactgaagatgacaggcatgtcattggcatcattcagcagcttctttaccgatttcaggttgtaggctaccgcagaactgcggctgtccatcaggctgtctactttagagaagatggcatcggcgcgaggatcatcccccaccagttccacatactcattggtgggcccccagtaaccttgttttttcgtggggctgttaccgtaacattgctgacgggttgaagtgttggtggcatctttttggtcgaatacacgagcgaatagaatctctttggttgttgaaaacttatcaaaaacgtcaccatagtttgcttccggcaatggagaatttgtatcaattgcatcattaactgctgctaccgcttctgtgtattttcctgcatacagcaatactcttgcctttaatgccttggctgcttctttagaagcttgtgaaagctttttccaatcaggagctttttcaatagctatttccagttgatccagaatatattgataagaatcggctacggagctacgcgcctttaaagcattggatacggatggagcttcattacgcatgacaactccgtattcactattcatatcccaaaattcgcagtaacgaaccaggatattgaagtaggccaaagcgcgtaaataggctatttcacctaacacttcggctctacggtttccggagaactctccgtcactcatgcggttacaggctgtttccaggaagttggcgtttttgattacagcgtaatctgcatcccattccgttgcatcactgaatgatagggtaggcaacattcgttcggagtagtaaacggcattaccggcgctgacaatttcttgacgccacatggtcccggctttgaaggaaccacttactgtaggaaatatgacattgaatccatttccaggcaaggagtaatagattccgtttaaggctaactctacagcagcgggtgttgtgatggcaccgtctaaatctgcttcgaattcgggcttttggtccaagacatctaccaactggcacgaggaaacgcccattgtaagtaaagctaagaatatatattttttcattcgattatacatttaaatgattataagttaatttttaaaccagccgagaaagagcggaaacccggataagtggaggtttcatagttaccgccatagttgctgttactgtttacggtagcagggtctgttcccggataagaggtgagcgtgaacaaattggtagccgagacaaatagttgtccttttatcactttgtttaaaggtaaattataagtcagacgcacttcctgcaaacggaagaaggaggcattaaacaattcatgatcggttagtctaggtacaccgtcacctatatacaaggccgggtatttggcatttttgttggtgtcagaccatctgtcattcaatccatagtcaatcaaaccggttaattgtccgggtagattctgcaatgttttgttataaatcttcaaaccaccgatctgatatccgaagttggcgaacaggctgaattgtttataagataaattggcagtcagaccgccgaacagatccggatcaggattaccgataataacacggtcattgtagttgatgattccatctccatttaaatccttaatttccaaatgtcccggttttaatgagttaccatcgtaataactttgtccctttgatttagcataggcattcaattcatctattctggcttgatcttgtatgatcccggcatattcataaccatggaaagctcccattggatagcctacagccaatacttggtcggcatagctgccttgaactactacatccatagctgattgtgctctaccttcttcaaccagtttggtgactttattcttgttatgtgacatattcaaggtcaggtccaagttccagtctttagtagataatacacggcctaccaggtttatttcaataccgcggttggtcaatgctccgatattacggttcatctgcatagagccaccggttgcactgggcgggaaatcaaatgaccagatcaagtctttggtatctttgatatagccggagatagaaccggtcagtcggtaatcgaacaatgcgaaatcaagacctaaatcatattgggtcgatttttcccaacggatgtcgcggttacccacttgtttatgtataatggctgacagattattataactggttgcttcgtataaatcacgattagagaagctggttaagttttgggtaccggtagtacctacgctggcacgtaatttcaaatcattaatgaatgtcaggtttttcatgaatttttcctgagagatacgccatgcaatggctcctgaagggaagaaaccataacggttgttcgaaccaaacatggatgaaccatcataacgtcctgtaaaagtgaacaggtagcgctccattaatttataattgatacgggcaaatgaagagaacagaccacttgcattatatccgttactccaagatgagatgcttgcggcacttcctaaattggtgtaaatatcattatccggataagtctggccattcattcttgtactacggcttataccacgttcaaaggagataccggctacggcatccaaaacatgattcttgttgaactcatagttataattcaatgtattgtcgaatacggtttttgaatatttataatgatattctgacccactggcttcatttctagtacttagaaaacttggactgaatgaattgttttcagtaaattgtaaattacccgataaactggaacggaaccggaatcctttccaaatatcaacttctccgtatacggttcccatgatgcggtaaatattatcatggtttttcttataggtgttggccaccgggttggcttgacctgtggacatatcaaattccccgttatcattatatataggcatatcaggacgataaccttgtgcgctgaacagtgaagttcctgcattatcctgatctgtataactcatattagcattgataccaaaacggaggataggcaatacattcatttctgtagacacgcgtgcattatatcggcttaagtcacctcctttaaccataccttgctgatcgaatatggataatgaaataagatatttggaaactttgctacctccacttactgtcaagtcggcattgtggcggatagctgtttgtttcacttcgtcaaaccaattggtgttggcactgcctaatgcggtggaattaggctcaagaatttctagtgcatattggttggacggatcatacaccaaggtttctttagcaaagcggcgtaccgtttcgcgccattcatcaccatacaggatacggaagttcttaatttgaacatcagtggttacattatagttgaagttgacggtaggtttggaaccctccacccctttcttggtggtaacgataaccacaccgtttgcagcacgagaaccatagatagcagctgcagaagcatctttcaatacgtccatagattggatatcattcggagaaatggcatccagcatgctgggatcttctacaggaactccatcgataacatacaagggttcattagaaccggttaatgacgtagcaccacgcacacgtacacggactgtctcacccggaacaccggtattctgtgacacctgtacacctgctgccaggttttgaagcatagaagttacattaggagtattcaattggctcaactgctttaggcctactgaagctacagagccggtcaaatcctttacagaagaagtaccataacctactacgactacttcgtccagattggtcacctcgctttccatttttacattgaaaacgtgtctgttgccaattttttccttaactgtctgcataccgataaagctgatcatcagttcgtcgtttttagtgttttcaggataagacagcatgaattgtccatccatattggctactgtaccgaacgtggtgccttggataacaatagaggctccgatgaccggttcgcccatatcatctttgatcactccggtaattgttctgcgcttggcatttctgtcaatcggtaatatgagtacataattgttctctactaattcatagcgcatacctgcctggctacaaatcacggaaagtgcttgttccagaggttctttgtttaatgtaagtttcaaaggtacattgttcaatgttgcatcttcgtacatgatatgaatgcctgtttgctttttaaccatgttaagagcctcttttacactgatgttttcacttttgatagtgacagtcttgtcggctagtacgtttgcaaacattgcgttgaatgtgcagaatatgcacattaacattactaatagcctcatttttggaggtttagctactaaacgattccaaagttcgtcttttttcataaaactcaaataactcatttaatttagaatattcctgttatacagggtttgattattgtttttttacaaatatagtttctccttttctctcaaacttgacatcggatacgcgatgaataatatctaatgcaaaatccaaaggcttgttacggaaaatgattccggtaaacttcatggtttccaattccttggatgctatttgaatatctacattatagcatcgtgacagtcgggctgtcagcaaagggaatggcattgcgtcaaattccatagcaccatctgtccatgaagtatagaattctgtatctactttgctaacttttgattgtgcagaagagtaatgttcacctggcagcaggtagtattcacctgaaggagcagttacttttagtttaccttcaatcagagtcacagataattcttcatcgggataagccgagatattgaaagttgttcctaatacataaatagcatggtcgtgtgcttttattatgaaaggacgggctgcatcgtgggttacctcaaacatagcctctccttctaaggtgatttcacgggtatctccaaactgaaccggaaaatcgatatgggagtccgcattcatttttacttttgtaccatcagccaatactattgcatattccgaaccttttggcactatgatcttattttgtaatagttcggtatccagttctgttttatgggggtaatcactttcttgagggaatatgatttctccattgttaatataacttccgttgatttcccgttggttttcatagaggggaattacagattggtttgcttgtacccaggtggctttaggagtttgggtgttctggggaagagatgattgctcgctttgggtaatggcaggcgtcagattccggttattaaaatataaaatggaagcaatccctatgataacagctatcgcagcggcagatgaataaatcgcaacccgatagcggatagagtggggctgcttgcaacgtttttgaatagcttcccatgaagcttctttatcaaactgttgtaataagttaagttggttattgacatggcggagtgaaagtaacttcacaaaaatttctttatgtgaagcgtcttcttcaatccattgttttaattctttaaattcctgttcattgagttggtgggacaggtatttttgaattaaggtttctgttttactcttttgcataattgttgtactgtttaacactaagtatcacaaatacgcaaaacgggtgacaaaaatctgaagaaaattataaattaaataagattaggatttctatcatattgaaacgacgcaacatttttaatgcgcgtgataaatgagtttttactgtatttacggaaatatggagttcttcggctacttctttgtactttttgtcttccagaacaatcttgactaaaacattgtattcctgttccggcagtttttttaattcggccagcaactggcttcttttttgcaacagttcttcttcatcataaaagtcatcgatgggagaataagattcttcctccagctcgtctaaggagaaatagcgttcccgttgtactttggtcagtgaggaaaaacggacggcattgaacaaccaagcatgtaggttggaggaaatggcagtatgcgagttcttgtcccagaaactgacaaatagattctgcacgatatcttctgaagtttccgtagagcctgtgaactgtacagagtaaaggcataagggaaggtaataagtatcataaagcagacgaaaggcttcttctttgttttcagtaaagagggctaatatcctttcgtctacttcatcatatttattgtattttcttgcattattgtccatagatgccttttatggcacaaaattaggaatttaaccggcaaaatgtgcgatttacatcaaataaaaatgcaaaaagtacaatgtatatagaatatcttctttatttttcaattctgaaccagtcagcgtccgtccatcctccgtcattggttacaatagcggggcgcgtacagaagatacctaccttggctcctatccatttaccttcttttacttggaaagtttctcctaatggctggaatttcttgccgtccgtactgtaactgaggttacatttcactaacaggtcgtgaccgccttcactggctttaatcttgtctccttttgcggaaaatttagcgcgaagatagattgtgccgtcttttaagggaacggaagcatttactttttcagtaccccctcgatcggctttcaggcattccacttgtgacaggacgagtccgttgtctgtgttttcaacaactaatccggcataatccattcccattacaaccagtcccgtacgttcacctttatatttttctgtcggcttgaaagtaagcttggtggtggcagtgaaattgggagccggagtcttttgtagcatcagattagaaacatcccataaactcttataatcttcgggaaccgggtaggagtatagacgtacaaatccttctcctccgttgaaataagcccatttttcattgatgttagcctgccattgccattgaggagacaatgtataaccatcaaactcgtcactttcctgcggagtacaaataggatagttcttacctacattaggctttttataagtcagaacaggttcgccacagccgtctccgtctttatcaatacctatgacgggccaatcatcaacccatttcataggttgcaggtgaaccaggcgtccgtaagcacctacgtcctggaagtgcatgaaccagtcttctcccgtaggggtgtccacccagcctccctgatgaggtccgttgacgggagagttgccttgcgctaatactgttttccattcgtatggaccgtatacgttttttgagcgaagtacgacttgccatcctgtaggaacgccgcctgccggatggaagatgtaatagtatccattacgtttatagaatttgggcccttcacaagtctgatgtgcttcatgaccatcgaaaatgatacgggattgtgtgatagctttacttgcatcagcacttagctcacaaattgtaattacacttttcagtccggcccggcttcctgcataagcgtgaaccagatatacacgaccgtcatcatcccataatggagtcgtgtcgatgatgccctttccggctttcaccaaaactggctcgctccagggacctttcggatctttggctttcaccatgaatgctccttggtccgggtcaccccagaatatatagaattcaccgttatggtggcggatactgggtgcccatacacggttgccatgttcaggacggacatcggtaacagggggcagtgcgtagggtacagccgcacctatgatagtccagttgacaaggtctttggagtgtaatatttgtaaaccgggcagacagttgaaactggatgaggtcaaataataatcgtctcctacacggcaaacgtccggatcggagtaatccgcatacaggactggatttttgtaggtcccattgccttggtcggccacccaggcttgggatacataattctgtgcgggagcagataaaaaacagcctcctagcagacagagagtgattagtcgtttcatggttttagattttttatttaatcgtaattttgcaaggatgttccaattcttttctccattggggaagataattgaaccagtctttcatatctttaaatccgaaactttctttttttgaggtgaaagtaacgtaatagtggaaatgctgttgccccggtgcttgtaaggtatataagtagtttgatccgtcttgtacttctttaccgatatatttaggaatgaaagttcccatacctgttgtttccttcacataacctatggtgtctgtgacaggccagtcggttccccagcttccagtcagtcctttatggtcgctcatgtgacctccttctttcagaatctgtacacctgctgcaaagacttcctgtttaagcggacggtcaaacaggacatctaccttcatgtcccgatgaccgccatagatggtatatcgattgatcatgttcaaatcgtttccttgatattcccaaccgatgacttctgcttcgacgatggcacgtacaggaccggaggctagtacacgttccgtgcggtttactactggttttatgtgggtcgcctcagtaccattccaaccttttaatgcacctacaccaccactattgtaaacacgtagcgcatcatctccgtagccgttggcacgttgcgctttggtagggtagaaacaagtctcttttatttccagtcttttatttactttgctatatggatctaccgtctgtttttcgttgaaatagatacgataggcaactaattcactctctatagccggtccgtgatggtaaacaaaactatatacattctcggttcctgccgctgaaaatcccgtaatattggcgaatttgttgttatgtccgtaagctttcatttgggcataagtacgtgccggatagtttttttcacttttttctgaagagagaattatacggaaacttttgttgcttttggctggcatatcgatgaggaaagccagttcgtcagcacgtgcgtcaccgttcagatcgtccagttgggacggaatttctttattaccttcccatacagtggcggatttgatgttgaaacctgctttcaggttatttaaatctatcactatcggttcgtcggtcttattttgagtccattcattgctgacttctacggtcagtgtcttttcgcctttttgtgcaaaagagttggtaaagcatcctgctaataatgtgaggacaataattgagcgctttttcataatgatgtatagtttattattttaagcacggatcatacggattacacagtgttagtatgaaaaccgtgtttatccgtgcaatccgtgctttactatttttataaattaagtggagaaatgcactaatgggtgtaagaattagaagttgagttcttctccttgtgccccgatttcagcatgattctttccgtctatcgttacattggaaacattttgcatcttcaagttctttccactttttaataactctattttgatatttttcatattaacttcgtcggcttcgcttaatactacaccttctttagcattagatacgatgatattctccatattgatattcttgattctcatctcaggcaagccattgaagaacacagccctgcctgctccgttacaggttacatctttgataaagatattacggaatatcggagtttcttctgttacaggagggatggtagtttctgctttcttttcatcctgattaggatcttcaccacgaccttttccaccatagtataaattgaatattaatgcttcgttcggaatattaatcatgttgatattgctgatgtagatattctctaccaatccgccacgcccacgattacttttaaagcgtaagccaacatctgtacccatgaaagtacaattgtctacatatatgttgtttacacctcctgacatctcactacctacaacaaaacctccatgtccatgtaatacggtgttgttcataacgataacattttgacaaggttcaccgcgtttgcgcccttgttcgtcctttcctgactttatacagataccatcatctcctgcatcaaatgagttgtttataatcaatgctttattacatgattccaaatcaagagcatctccgttttgtgagtaccaaggattagaaacagtaactttattaattgtaatattttcacatgatagcggatgtaagcaccaactgggtgaatttttgaatgtcgctccttccagcaataccttattacatttgatgaaacttagcaatacaggacgtaaccagtcgcgcatgtagtcccagtcagaatcggtaagttctccacgaggtacgttgaagttgtcttttgacaggatagcacctttcaatgcaccttcactaggataccagattcttccgtcggcatctaccacaccaccggaggcgaccaattttttccattggccttcagtcagtttatctttcttggtcggacgccatgtgtctccattaccatcaaatactccgtggcctgtaatcgctatattttcagcattacgtgctgaaataggagactggcaacgacgggtttccaaaccttcaaaagaagtgtttataatgggatatagtgaatggtctgcactgaataatactaacgcattcttttctgtatatagattcacattgctcaatagttcgatgggaccggttagccacaagccttcaggaataatgactttgccacctcctttggcattaacctgttggattgcatcattaatagcctttgtgtttaaagtaataccgtctggcttggcaccgaaatctatgatgtttaccgaatagtctgggaaagtaggttgttcaactttatccatcttgaaagggaggcttgtatagatggcgggatctataatatcttctacaatagtcgtagacggacaattattacatccggtcaaaaaaggaattaaacatgtggcaggaagtaatagaatcttctttattaaagtagtcattggtattatatatgtttaagattaataattatctagttgattgttgctttaagaagtcttatcactctcccgtaaaagaccctcacgggctatttacgggagcagcaataatgtttcatgttaacctaattctaaccttaaataaatattatgaaaaaacctcttaattcaatggcaaatatagctgaaagaattgtcctttatgtgcactatttgatagaataagtggattttttgttaaattctcatttagctgaaaccttaaatggtaaaaattagttttataattgcattatttcttcatttgtgtgcaaaaaaagctatgattaatttatttgtttgtatctttgcaaactaatttaacaataaagaaggtatgagttacaatttgttgaaaggaaaaagaggtattatttttggtgcattgaacgaacagtctatcgcatggaaagttgctgaaaaggctgtagaagaaggtgcgtccattacattgtccaatactccggtagctgtccgtatgggagaagtttctgctttagctgagaaactgaattgtgaggtaattccggcagatgcaaccagcgtagaagatttggagaatgttttcaaacgttcgatggaaatattaggtggaaaaatagatttcgttctgcattctatcggtatgtctcctaacgttcgtaagaaacgtacttatgatgacctcgattatgatatgttgagcaagactctggatatatctgccgtttcgttccacaaaatgattcaagctgctaaaaagctggatgctattgcggagtatggttcaattttggctttgagttatgttgctgcacaacgtacattctatggatataatgatatggcggatgcaaaagcattgcttgaatctatcgcacgcagttttggttacatttatggtcgtgaacatcatgtgcgtgtgaataccatatctcagtcaccgaccatgactactgccggttcaggtgtgaaaggtatggataagctgtttgactttgctaaccgtatgtcaccattaggcaatgcttcggcagacgaatgtgcagattactgcattgtaatgttctctgacctgactcgtaaagtgactatgcagaatttatatcatgatggaggtttctccagtgtaggtatgagtttgcgtgctatggcaacttatgaaaaaggtctggatgaatataaagacgaaaacggaaacatcatttacggataagaaatagatgatgcgcaaaattatattcatattagtagtatgtcttgttgctctttcctcctgtcagtgggatgggaagagtggcaatactgctgatgtggatgtaagagttgcccgttatgatcgtttgcagtatgagtatgtcacgatgaatagtttctcggcactgcaaaaaatgaatacggactatcctcaggttaccaagctgttgatagaagatgtattggcgataggtgaggtggatgacatgaagattaacgaccggatgttggaatattattcggattctactttattgactttgatgcacgatgccgaagagaaatttaaggatcttggttgggttgaggaaaaactgaccaaaggttttaaacgtttgaaaaaagaggttcctacattgttcgttcctcatttttatgctcaaatagctgctctgaatcagtctgttgtagttggggatagtattttgggttttagtattgataagtatatgggagcagattatcctttatataaacgcttctattatgactatcaatgtcgcagtatggagcctgatcgtattgttccggattgttttaccttttatttgctgagtcagtatcctttgccatggcagcctggtcgtactttattagatatgattatgcatcgtggaaagataaattggatagtggctcatattttagggtatgaatcttttgagaaagagatgggatatagtgaggatgaggctgagtggtgcaggaagaataaaacaagtctgtggaagacaatggttgaaaatggtcatttatatgctaccgatccccttgttgtacgtacttatatacgcaaggatccctttatttctattatgggtgagaaaactcctgcaagtattggagtatggatggggattttgctgattgatgaatatatgaaaaagcatcctgatatgacaataaaggatttgttggctaagacggattatcatcagatgttggctgaaacagatttcaaaccttgatattttgattgattagtagtatgatggaagttgctttgtatctattgcctgtcacattaggcgaaactcctgtggaaaatgtgttgcctgtgtataataaagaggtcattctcggcatcaaacattttattgtagaagatgtacgctcggcacgtcgctttttgaaaaaggtagatcgcgggattgacatagatgcattgactttttatccattgaacaaacatacttctcctgaagatatttccggttatctgaaacctttgttggccggacagtccatgggagttatttctgaagccggttgtccggctgttgctgatcctggagcggacgtggttgctattgctcagcgtaagaatcttaaagtggtgcctttggtaggaccttcctctattattatgtctgttatgggatcgggttttaatggacagagttttgcttttcatggttatttgcctattgagcctggtgagcgtgcgaaacgtattaaggtattggagcagcgtgtttatgcagaagatcagacgcagctttttattgaaactccttatcgtaataataagatggcggaagatattcttaagaattgccgtccgcaaaccaaactttgtattgctgccaatattacgtgtgaaggagaatatataaagactaagacaataaaggagtggcaggggaaattgccggatttatcgaagattccctgtattttcttgatttataagtaatgcgataacagatattcatttaaattcctcccacatctgtgtcactatgttcagatgatctatttcttcttttagaaaagaactatattgggcagaattcatttctatttcttcgggagttacaaattttcctccggtaaaatgtatctgttcttcatcgtttaaaggaagaatatatagcatgatggtttttttaactccattggtttcttttaccaaatgtttcaaactgaagcgtggttccggttgtccggtaatatggttgctatatttattttctacttctttggcatatttatccgtatctgtcttgcaggcataaatgtagtcttccataggtatgtccaacttgccgggttcttcaccttgataactgcggggagcaacatagatctttccattgcaaataggggcgatacgtaaaaaaggcatttttttataggttaaactgattgttttcacaaaagcatgattgacaataatgcaaatgacatatatcaaaggagggatgatgtgggtcatagcgtaaagggtattataagatagtggactgaaaaataaataaattatgcaggaagcaaacaggtgaatgccggataaaacagctataacctgtgtggcccaacagttcagaatagatatcttataatgaaagtaggagaatagttttgtataaaaattggggaccatgagatagagtagtgaaaaacagagtatcagtatttctagcgtaatgggaactgttcggtccggaataagcatatctccgcttatgccttttatgatggatgcaatgattaatgccaaagttccatgtagtaatactagatttggctgataaacaggaggtttgacaagtctgtataggatataaataatgctagccaaactacagacatacaaaacaactgcatcttgaaagaaaatgcagaaaatcatgcatacaatggctggtattaaccctgtggacatgattaaattcttgtattccagtaacgatttcattctctctatctctatttatatctttataacaaaaaagatataaagttggtttactcgttaccctttaaattttatatgtttttctgcatgataggaggaacgtaccaaaggtgcgctttccacttctcggaatcctttctttaatccaattgttctatactgtttaaattgatcgggagtaatatattccgctaccggataatggcggtgggtaggttgtagatattggccaatagtaagtatcttgcagccttgtgccaataaatcgtccatgacttcttctacttcttccgggcgttctcccaaacctaccataataccggatttagctgtaataccattattggctatttgtttgatgacctttaaactggttgcatagttggctgcgcttcgtaccaggggactgatgcggcgtacggtttccatattgtgtgagatgatgtctggtttggcgtcaatgactagctgaatcagttcgctctttccttgaaaatcagggattaaaacttcggttgtggtttccggattcaagcgcttgatttctgaaatcgttttagcccaatgggcagcacccaaatcatctagatcatcacggtctacagaggtaataacggcatgagataatttcatgagttgaatggactctgctacatgggtgggttcttcagggtctaacggaagaggccgtccggtctgtgtgttgcaaaatttgcaggaacgggtacaaatttcgccacctatcataaaagtggcagtaccttttccccagcattctcccatattgggacatcgtccgctactgcaaatggtatgtagtttgtgggaatctacaatatgtttggtttcggtatatcgagcatttgcccctatgtttatcttaagccagtctggttttttaacgtgattcatgatgatattagatttataattcaccacagattataccaatgcaaattgttttcattcggtttttatgtaaaattgtataatctgtggtgaatggttttttattttaaattatcaataaagaaattggctacgcgagtcagtaaatgtttagttgtgttgcctccactgattccatggttgcggttggtatagatttgcatgtcaaattgcttgtcggcctgtaccaatgcttcactgtattctgcgttgttacgtaagtgtacattatcatctgctgtgccgtggatcagcaacaattcaccgttcagtttgttggcacggttaatagcagatgcagcattgtaaccttccatgttttctttgggggtacgcatgaagcgctctgtatataccgaatcgtagaaacgccagtctgtaggagctgcaacagctactccagctttgaatatcggtgttccttcactcatggacattaatgtattgtaacctccatagctccatccccatataccgatacggttaccatctacatagggtagtgtacttaagtatttggcggcttctacttgatctttcgattcttttactcctaaactcaagtaggtgcatttttcaaaatcagaccctcggccaccggttccgcgtccgtctacacaagccatgatgaagccttgaccggccatataagcttcgaacatgccgccatctctacgggctccaattccccatttgtctgcaacttcttgtgaacccggtccactatattggtgcatgataacaggatattttttgttcggattgaaatttgcgggtttcattatccaaccattcaattccacaccgtcattggtcttgaaactaaatagttctttatttggcatattcagacgtgaaacttggtgtttcaatgtgttattatctactaaggttgccaattctttaccattattgtcattaagggtaatgacaggaggggtgttgatattagagaaagtattgatgtaatacttcatattgttactgaaaatagctttatgagttccttcctgtttggatagtttggtctttttacctttgccgtccactttgtagatagcggtgcgtagcggactaccttcattgctttcaaaatagaatgtgttggtagcttcatcccatcccaggaaatctttcacttcgaagttcccttttgtgatttgcttaaccaggtttcctccgctagtgtaaagatagagatggttataaccgtctttttcactcatcaccacaaagttttttggatagaaaacgatgttggagtaggcttcttctttaatgtattggggagcttcatcacgtaccatcagtttacacaatgtacttcgtggattggcaaaatagaggtcgaaacggttttgatgacggttcaaagtcatgattgccaacgcattttcatcatccgtaaacttgatgcgagggatataaccgtctgcatctagaggcaagtccatcttgcgggttaccttactttttatatcaaaagtatgaacggttactttggaattgtcaattcctggcatagggtatttgtattcatattctcccggataagtgctgaatttctctaatgcgggaaccatacctttgtatagtggaaaagaatacataggtacttgactctcatcaaaacggatataggcaagcatctggctgtctgcactgaagtcgaaagcacggttgaagccgaattcctcttcatatacccagtcgggaataccatttagcacttcgttgaatttgccgtctttggttacttgtgattcactgttgccaaacaataattttaccagatagatattattatcacgtacaaaagctatctgattgccatccggcgagaataaaggaacctgttgtggaccgttttctgagagcggttccattttattgttttttacgttgaaaatatagtaattggcggtaaacgaacgacgataaataggtttggtttcagtctgtattagaatcagtttttcatcgggtgacatgatatagtcatcaaatgacttgatgctacagtcacgggccgtatttacatcgaagatggtacctgtttctttgccggtcttgaaagaatactgtatgatttttttgccatcggcactcatttgggtataatgttctccatccaacatcggtttgatacctctgattccttcggcatgatacgttctgtttgctacgtcttgcaagcttacttgttgagctccgactgtcagcaagcagaagaataaaataataaatatacttaattttctcataatagataaattctttaaatgataatcaaagacaaaggtaaaacttttgtttgaaaatacgtatctttgtcccgcaaaataagttcatgaacagagagatgctttataacgacttatccggctttttagctatgcactttccttgtaaagtgcagaagatttctattaatgccggatttacttgtcctaaccgtgacggctcggtaggatacggaggttgcacttattgtaataatcaaacatttaatccggcctattgccatacgggaaagtctgttgctcagcagttggaagaaggaaagcggttctttgtacgcaaatatccggaaatgaaatatctggcctattttcaggcttataccaatacgtatggggaactggaagagttgaaaagaaaatacgaagaggcgctgatggtagaggatgtggtaggactggtgataggaactcgtccggactgtatgccgatatcattattggattatttggaagatcttggtaaacgcacttttgtattagtggagtatggcattgaaagtacggatgatgaaacgttgcgccggataaaccggggacatactttcgccgtttctgcggaggctgttcggaagactgcagagagagggattttagtaggagggcatataattcttggtttgcccggagaagaaagagaaatgttaatcagacaggcaggagtactttcacaattacctctgactactttaaagctgcatcagttacaacttattaaaggtacgcgcatggcgagtgaatatgtgaaagagcctgaagctttccatctttatacagctgatgaatatgttgatttggttattgattatatagaacatcttcgtccggacatcgtactggagcgttttgtttcccaatcacctaaagaattgttgatagctcctgattggggattgaaaaattatgaatttacggataaggtgaaaaaacggatgagagaaaaagatgcctggcaaggcaaatactataaatattaaaagaagaaaacagatatggaaatcaaaggaaaagtacattatgtgggagtgaatgaccgtaacaaggctttgtttgagaacttgtggccgttaccttacggtgtgtcttataactcttatttgattgacgacgagatggtcgctttggtggatacagtagacgtatgctattttgaggtttatttgaagaaaattcgtagcattatcggtgataaacctatcaattatttgattataaatcatatggaaccagaccattccggttctatcagtttgatcaagcaatattatcctaacattgtgattgtcggtaacaagaagactttcgaaatgattgaagggtattatggtgtaggcggtgagcgttatgtagtgggtgaaggagattttctagctttgggacatcatagactgcgcttttcattgattccgatggttcactggcccgaaacgatggttacttttgatgaaacggaaggtattttgttttccggtgacgctttcggttgttttggtgcattgaatggtggtgtggttgatacaaatattaatacagatatttattggaatgaaatggtgcgctattattctaatattgtaggcaaatatggtgcgccggtgcagaaggccttacagaaattgcaaaacttgaaaataacgactgtttgttctactcatggtccggtatggacagaggaaattcctcgtgtggtacgtatttatgaccgtttgagtcgttatgaggccgaagaaggggttgtaatagcttatggctcgatgtatggtaatacagaggaggtggcagaagctattgcagaagaactgagcaagcagggaattcgtaatatcgtgatgcataatgtttctcataccagtcattcttttattattgcggatgtattcaaatataaaggactgattgtgggatgccccacttataatactcagatgtatccggaaatggaagctctgctgagcaagctggcttctcgcgagataaaggggcgttatctgggatattttggctcatttacatgggctagcgctgctgtgaagaaaattgcagagtttaatgataagttgaaatttgagcctgtcggaaatcctgtagaaatgaaacatagcatgaaggccgaaactaacactcaggcaaaggagttggctaaggctatggctgatcgtttgaaagcggatagaaaataaatcttgtgatagcatacaaatgacgcaaatgacacatgattgataagatcaagcttgtgacaattgcgtcattcgtgttctaaagagggatattcagtaaatgtctctaaaaaataagatggcatatgaagatgatagggcggaggacacgggaggaaaaagacagacacattataatattcgcacgcgcgtataaggacggaaaaaggaaggaacccatacgaaaacagcagacggaaaaacaaggaaagacggaaaagaagcaagtccgaaggacaaccggacaggttacgaaacacaaaccacagagctctcaaaagtgctgactccgcaaacacaggggaaaaactgtaggagaaaaaatagaaaaacagtcgcatcaagctcggatcatacttccccaccaaagtccgacaaacccaaaattccgaataaagaaatgaaacttagttcctgtttaactgttgttccgtattcttttgaaagtttttttaaagaaaatttaaatagattttcatattgcaaagcaattcctatctcacactccaactttcccccaataacacccgagcatgttgcctacaaccaaaaacagttcttataacctgtcttccccatttattttgtacctttgccacacattgaaaatctataaaccgaaatattataaaactatggcaaaggaattagaattaaagtacggctgcaatcccaaccaaaaaccgtcacgcatcttcatgcaagaaggggaattgcctatcgaagtattaaacggacgtcccggatacatcaattttctggacgctttcaacagctggcaactggtcaaagaattgaaagaagctaccggactacccgcagcagcctccttcaagcatgtcagtccggcaggagccgcagtaggaatcgagttgaatgacaccttgaagaaaatttattttgtgaatgacttgccacttaccccattggctaccgcatatgcccgtgctcgtggcgctgaccgcatgtcttcttacggagactttatcgcattgagcgatacttgcgacgaagctaccgcgcgcctcatcaaccgtgaagtttcagacggcgtcatagctcccgattacacaccggaagcgctggaaatcctgaaaaacaaacgcaagggaacatacaatgtaattaaaatagacccagcttaccgccctgcacctattgaacacaaagatgtattcggcattacttttgaacagggccgcaacgaaatcagactggacgaaagcctgctgactcatattccaactaaaagccagcattttccagacgaagcaaaacgcgatttgattattgcccttatcaccttaaaatatacacaaagtaattctgtttgttatgtaaaagacgggcaggctatcggcatcggtgccggccagcaaagccgcatccactgtacacgtcttgccggtaataaagcggatatatggtatttgcgccaacatcctaaagtaatgaatctgccgtgggtagaaaaaatccgccgtgcagatcgtgataatacaattgatgtctatatcagtgacgatcatgaagatgttctggctgacggcatctggcaacaattcttcacaaaaaaaccggaagtgctgactcgcgaagaaaagcgcgcatggctggataccatgaagggggtatcattgggttcggatgctttcttcccatttggtgacaatatagaacgtgcgcataagagcggagtggaatacatagcacaagccggaggctctgtacgtgatgaccatgtaattgacacttgtgacaaatacggcatcaccatggcattcactggtgttcgtttattccatcattaattattctcagtgcaaattgcaacacggatttacagatataaagcaaaccatacttagcctgtaagatccgtgtttacaatccatataaaaaatcgtcttaaaatttatatcccgctgttacaaagccggtaatattcttcccttgaagttctttttgaagtttgcacagccctaatcgtccttccactcctatcacataatgccggtattccaccgataaacctatcgccactccataatcgaaacgacgcagatcaagtccatctttgccaaaagtatttatttcaaccacatttccagtattccaatccggtgtagacgatgatgaccagctataccctaaagccttggttttgccaccaatcccccatgcgccatagggacctgccgcaacaagtatataagtattccgatccattgcaaaccgggctgccaccattacaggcaactccaaataggatgcatttactttagcctgagccgaaattccatctgtttcaacaatcgtatgattagtgcctttggaaacaaacgaaacgcctgtttgtaaagaccagatcttatcaaaagggcactccaagccaatgcctaatttatacgccagctttactttaggagatcccatattatcacctataatatttgccatgcctataccggcctttatactccaatccacctgactctgagccggagtcaccatgcttaccatcataaacagtgcaaaaagaagtagttttatcactcttaccttatctattaatgccatatccctaaaaaattgtgtctttaatcataatctgcaaatatagcttttatttcataaaccacgcttcatctaaaaaaatggctgcttctttctaaaagagaaacagccgttctttatatatttaaaggtaagattatatctgtggtcagaatttataaccgatagtggccaatgcagaaaggttatgagcactaacaccgctagctactttagtaaaacttgtgccagtttcaacacctacaactatgttgccaaattcaaaagcaactcctaaccccaaaccggcatcgaacctttttaaaccatcatcaccgaaagtatcagccttctcggatacaccatctattttagtttttccgccaactccataagccaaatacggaccacctttgaaaagaagatcaaaattgctggccgtatgtatccgagcaccaaccatcaaaggcagttccagataaagctggttgatcgtcacatcaaccacgtcccaagcatcagttactccatcacctttcacacctttagaaataaagttcaaacctgtctggaaagaccatatattagtattagcaaaaggtacttccaaacctatacccaccttataagcaaatttagcatctgtaccatccgtatcatcaccataccaatttgacataccaatacccgcattcacattccatttcagatttgattgtgcagaaacacctagtgtaaccaatgacaataaaataaaaaaggctagttttttcatgactgtttgtttttagttaataataaatttcagttcccaattcctttataccgtcattacattcacaaatataagctttattttggaaaccagtcctaatgtgtaaagaaaataagcggaatctttcataaaatgaaaaattccgctcaccaaactattatacagttatatgattcctgattatcagatacatttatatatgattagaatatataatgaaagccaaagtttaactcatccgtatcaaaatctataccaacattttcactctcatatccatgattctcttttttggaatatccaagaaaaccatacttggcaaccagacaaaaatgatcagacaatttgatggcaatacccggtttaataccaatattccacgaattcaaagcgtcattccccttcgtttttgaagtagaaaagccaaatccgccatcagcaaataaccggactacatcactattcaaaaagaaataacgtgcataaggagcaatagtgaaagtattagttttcacatcaccgcttttattatattcataaccgactactgtaccgacagaccaatcttcatttagttcataaccgacctccggcagaatcttgaaagtagtattcttaacttctgttccttctgtttccactttatcagaacctactccaaatgttccacctacatacacctgcgcatttgcagtaatagcaatcaatgctacaataatagacaatacaatctttttcatctcttttgtcatttttaaattaaactttttacctattaatccacgccgaagaggtttgccttctttgtgttttacattgcaaaggtacagtttattctatgttttacaacatattttatataaaaacgaataattccaaaacaaaggagaggataattgtttaattattaataaagtactgaatattaaattcaatctacattcctatttattcttatgtctgttagcacgttttttacgaaactcagctttcatcttggcagctcccgacccatgcaaccctgttatatagcttttctttttagccttggtcttcactttatcttcttgcttaccactaggagatttaccacctttgaatacaattccttcggtgattgctttttctatgtccatcgtctattttttaggtgttaaattctgttttactatcactctattgccggctttggtacaaacaatttccgttttgtgcaaagtacggtctttcatatcaaaaatcagattcggattgaaatgttgtccatctatccggaattccagatgaaggtgttcagtagtggcacgtccggttctgcctgtcaatcctactgcatcaccggccttcacgatatctccggattttaccaaattccgggaattatgactataaatactttccaatccattatcatgacgcacaacaactacatttccataagcagcgtatgtttttgccatacgtactattccatcaaacgcacaacggatagtatcattggccttagtctttatatccgttccactgtgcccccggcgggctccgtatgcagaaatcactttaccaccgggaagaggaaaacaatattcattctcttttatactatccagatgaatggagaaacttttgcgcccgttaaagagcccgggagtcttgactctgatatggtttacttccattgcggtaaaattactcttggccggccccccagcccatgccgccacacttatgaacaataaaaatagtaattgtgtgcttttcattatctcattttaaaaataaattaattcttcatccttggacgctgcaaactctttcaagagctccaacatataatctgccgcttcctgcaaaccttccttgccgctatatccattaataatagtcagcagatgcgtagttcctgcctccagtttagtacgctcgttatcactggtcggcgtaccgattccgcccatagcatctctgtaaacaggcattccttctatattcaactctccacgtcctatcccttcataaggctctccggatttaccgatacccaacaccaatgtatctccttgtattttatccgcatcaaagccaccgatggaatatccgtaacgaatagataccaagttaataagatctaccaaagtatctatctgatacaaggaaattccacgcaggattctacggcagagcgcttcccccgaaggacgataacggctagggtctttcccacatttcttataagcctcccgagtggcatgaatcgtaaccatatccttaatggaatccgtagtgtacatttcacgatagcatatagtgaactcgtctatctttttccacaaagattcgctataagcagtgttctctaccgtagcacggatggctataccggcaaactgcggacaggctttctttatttcttccgatacttttatttccatatttatttttatactgcgttcttccaatgagtgtgttcctcagacacctaaaagaatgcccgataatatccttcccgaccggattccttgccggcgggccgaaaagaaatcatcgttattatgatacgtacaaatgccggatatctcaatatgttcaggcttcacaccgtatgccaacaattgctgacggttggcttcccacaaatcaatatgccattttgcttctttacgggcaatctgattcatatcaaaccccgcctcacaaaaagcttgataaacttcatcccctacttcaaaagcctccaatgaaatactgggaccgatgcaagctatgagatctttcccttgcgagccgtattggttatccatgactgaaactgtcttctccacaatccgggccaccgtaccacgccatccggcatgaatggcagccactaccttctttcgggtatcatataataaaacaggaacacaatcggccgtagatacacacaagcaataaccgggaatgtctgttaccaatgcatccactccttccaattcagtatttacctgaatagtatccacaactttcacatggtcactatgggtctgatgcggaattacgagttctaccgattccccgggtaacaagctacgcagcaattcccggttgcgattcacatcttctgcctcgtccccacaatatccgttacaattgaacgaagcgtagtttcccttactacaacctccgtgacgggtggtagaaaaacaagaaatgttgggatatgccttcatcagctcatatcccaacattttattatctgatgtcagccgtttcatttcttttcctcttcttcgtcccaattctcatcttcatattcataatcgaagtcatcatcggcatcttcttcatattcatattcaaagtcctcatcctcacccatgtctttcaactcttcctgcagtttggcaacatctttggcgcgatgaacaattgtttccgtacggacaccttccaacttattgctgtccttattcaattctgtccataaaatatccttcagctgctgtatccccaagccagttaccgacgagataaagatatgcggaacattatccggcaatgtcggctccaacatggcaatcagttcttcatccaacatgtcacttttggtaatggcaagcacacgttgtttatccaacatttccgggttgaaggtagccaactcattcagcaggatttcatattccttacggatatcatctgtatcacccggtaccataaagagcaacaaagagttgcgttctatatggcgcaggaaacgaagtcccagtccttttccctcactggccccttcaataattccgggaatatccgccatgacaaaagattttccttcgcgataggacacgatacccaaattcggctccagcgtagtaaacggataattggctattttaggacgtgccgccgatacggtagacaataaagtggatttccctgcatttggaaaacctaccaaacctacatcagccaacagttttaattccaaaataaccatcagctcctgcatgggttctcccggttgtgcaaaacgtggcgcctgacgggttgctgtacggaagtgccagtttcccaatcccccacgtcctcctttcaacagaattatttcttgtccgtgttcggtgatatcacagatatattcacctgtttcagcattataaacaactgtaccacaaggcacttcaataactttgtcttcaccatctttaccaaagcttttgttcttcgatccattgccgccgtgtgtggcaaacacgtggcggtcatacttcaggtgaagcaatgtccaataattacggtttccccgcaaaataacatgacctcctctaccgccatcaccaccgtcagggccaccattgggtacatacttctcacgacgcatatgcgcagagcctcgcccgcccttacccgagcggcaatatatcttcacataatcaacaaaattcgattcagccataattaataatttactaatttatcaatttactaatgtgccaacgaaactgtactccatgtatcattatgcagactgacacattggcggactgctgcatcagcacattagcatattactataatttttcaacagcagcaacaatgtcggcaaaaatagcatccatcgtacccaaaccgtgaatgtgctgatatttaccttcgttcttgtaccagtcaatcagcggagccgtctgcgagtgataaacaaccaaacgtttctttattgtttcctcgttatcatccgcacgtcccgattcctgtccacgcttaatcaggcgagtcatcaattcttcttcgggtacatccaagtccaacataacagatacttcctgtccacgttcggccagcattttcttcaacgcttctgcctgggcgatggttctgggaaatccatcaaaaataacccctttgctttccttaaagctatccagcgtacttgccagaatatcaataatcaattcatcaggcagcaactggccctgatcgatatatcctttggctgtctttcccaattctgtacccttcttaatctcagcacgaagcacatcccctgttgaaatgtgattaataccgaatttctctacaatacgttcactctgagtacccttaccagaacccggagctccaaaaattacaatgttcaacatcttgttttaccttttatttttatatttagttgtacaaatttcattccattacggtgtaaatatcccgatagttacgtcccaagccatcataatccagaccataccccacaataaaatcattgggaatacgcatggccacataatgtatatccaattccaccttcaatttatcaggtttcagcagcaaggtagcgatacggatctctttcggttttctagcttgtaatgtttccaacaagtgcttcattgtcaccccggtatccacaatatcttccacaatcaccactgtacgaccctcaatatcatcattcaaacctaccaactcttttacctttcctgtagaagaagttcctgcataagaggccagtttcacgaaagaaatttcactgggaatggtaaggttacgcatcaagtcggcagcaaacatgaatgcgccgttcaatacacttaaaaacaagggattagttccttctaaatcccgattaatctcactcgctacccgtgccacttcttttaagatccgttcttcaggaatgaaaggagtgaaacgtttatctttgatttgaatggtatccataaccgctattttattaaattgctgcaaaaataacatttttattccaagtatcgaagtattcacataacctctttttgtaaatagtgttatctttgtacgttcaaacaaaagagattgtcatgaaaattatttcgagcacccaactaaaagagctggacaagtacacgattgccaaagaaccggttgcctccattgatttgatggaacgggcagccgaagaactgactcgtgccattacccaccgatgggatacttctttccatattgtagtattcgccggaccgggaaataacgggggcgatgcgcttgccgtagcccgtatgttgtctaagcaaaactatcacgtagaagtctttctgtttaacaccaaaggaaaactgtcggaagaatgtcagaccaatcttgaacggttaaaagaatgcggctcggtgtactttactgaagtaagcacacaatttgatcctccagtcctgacagaaaggcatctggtagtagacggattattcggttccggactcaacaaaccactgaacggtggatttgctgccgtagtgaaatatattaatgcatccaaggcacaggtagtagccattgatgtaccttcaggattaatgtgtgaggacaacacttataatatccgtcaaaacatgatacgcgcggatgtcactctcagcattcagctacctaagttatcctttcttttccccgaaaacgaagacattgtaggcgaatggcaactattggacatccaactgaaaaaagactttattgatacagcacaaagtccctactatatcacagaggaagaagaaattcgcagtctcatcaaaccgcggaaacgatttgcccacaagggaactttcggccatgcactgctcatcgcaggatcttatggcatggcaggagcatccattttatctgcccgtgcctgcctgcgttcgggagtgggattactgactgtccatgtacctatccacaaccatgatttacttcagaccactgttcccgaagccattgtacagacagacatacacgaccattattttgccgagcccgtggatacagaccgttatcaagccatagccatcggtccggggttgggacaagaagaagatacagcgttggccatgatggaacaaatacaaggttgtccggtacctttagtgctggatgcggatgccattaatattttcggcactcaccgcaactggctcagccggatgccgaagcgctgtattctcaccccccatctaaaggaactggaacgactgataggtaaatgcatggatacttacgaacggctgacaaagacgaaagaactggcagcctatctgcaaagctatatcattataaagggatcatggagcacagttgtcacccccgaaggaaattgttatttcaatcccaccgggaatccaggtatggcaaccgccggcagcggtgatgtgctgaccggtattctggcagccttattggcacaaggatatactcaagaagatgcatgccgcctaggcgtctacgtacatggtctggcaggagacattgcagcggaagaaaaaggagaaataggaaccacctcaagtgatcttattgacgcattacccgcagcatggaagaaattaacagaaacaaaaggcaaatttacaaaagaatagctatatttgcttacatatatgatagaatatagaaatatgaaaaaaggattaatcgcagcagggttactggtttcattaagcggcaccgcacaagatgtcagtacatatactcccggaaccatgggagaaggagtggtttattatttgcctaagaccgaaatagaattgcaagtcaccgcaaccaaagttgtctacacgcccggagaattctgccaatacgccgatcgctatctgcgccttacaggcatatcatcccaaccggaagaacattgggaaataaacagtatcaaggtaaattccataggcattcctgacccggacaatgcatacgctgtaaaactgaaagacaaaagtgcggcctcacaggtagaattgactcctgaaggaatcataaaggctatcaacaccacctctcctatagagaaagcacctgtgacaaaggttgccgatacggtcaaaaaacgtattgacccacgcagttttatgaccgaagagattctgatagccggttctaccgctaaaatggctgagttggtggcgaaagaaatctacaatatacgagaaagcaaaaacagcctgacccgcgggcaagcagattatatgcccaaagacggagccgctttaaaactcatgctggacaatctggatgaacaggaacaagccatgatgcaaatgtttgccggcacaacagaccgcatagaaaaatcatttaccatccgcataaaaccagaagcggacatgaaagaaaaagtagctttccgtttctcaaagaaactagggatgctggatgccgataatttatccggtgaaccttattacatttccatcatcaaccaagaaacattgccaccgatggatccgaaaggcaaagaaaaaaagaagacggatggtgttatttacaatattccgggaaaagctcaggttaccgtattcactccaaacaaacgttattttgacggagaactacctgttacacaatttgggacaacggaatgtctgatagataacctttttaataaaaaagtaaatacacgagtgatctttaatcctaataccggaggaattgtgaagattgataaagactaaaactccatctcacccctacatagcaaaatgagggtatccataatacactggacaccctcattttcactaaaagacaatcaattattttttaatatttggttcctccaatccatacccctttttcttattctcacctttcagccacaaagcaaagaacaatgcagccacaccaaagcctgcaaatatccacatgggaagtgtataatcataagtctgcattccatctactaccggtcctttgcaatactcattcaagacaaaaccaatcaaagcaggtacacccatcaacccccagttttgtacccagaagatcaaagcgtaagctgtacccaactgcttttccggaataattttaggaacagagggccacatagccgatggcaccaaagaaaagccaatccccaatataatcataatgatagtggcaaaccaccatacattcaagacaggtaacgcaaacattgtatgaacaaaaatcaacagcacagaaccgatgatcatcagcgtagctcccttgcctatccgatcgtacacattaccgaaaagcggagtaaggaacaaagttcccaatggtaacaggctaggaatagtacccgccaattccggatctacattatatttctgcaccatcaggtctgtagcatatttcaagaaagggaatacggcagaataaaacaacacacacagcaacgcaatcagccaaaatcctttattggttacaatcaaccaaatatctttcatacggaaaggctcttcaggttccgccccttcttcttctaaagaagcatccagtttcttatcatagaaagtataaataaaaaatgctaccgtaccaatacaaagcatagtaaggcacagcaacaatggagcaggaatattaggatggaacacaccctcatcatcagtaataccaaagaaagtagcgataggaaccgtaacagccaaagccagcatagtgcctaaacgggctgtcgccatctccatacccatggccagagccatttcttttcctttaaaccacttcacaataatttttgaaaccgtgatgcctgcaatctctacaccgacaccaaatatagcatatcccaacgcagccagtcctacctgggttttcattccaagcaaagtgcttccctcagcaaatgtagtagaaatagcataatattttaacccacagcccaacaccatcaaaaggcatgctcccataccagtaaagcgcactcccatcttatccaaaatgataccaccgataataagcataaaggcaaagacattgaaccaaccgtatgcactggtaaaaataccataatccagactatcccacagcagctccttttcaagcatcggttttaagggggacattacatcggtcaaaaaataaccgcatagcatggtgaaagccaccaacgccaacacactccaccgaagaaccttggagtcattgagctttttttgaatttgttctttcattcttttataagatttttgattaatagtttttcatgttcagcttacaaagatacagttttttaggtagagaagcctctttccataaaaaagttctatctttgcgtgacgattaaatcgttttattgtaggaaatcgtcataaaattactttttataaacttaactttattgatcatgaaaaaaagcaaaacatttcttgtttgcgccatgttgagtggcagcgtcttattttcatcatgcatcggttctttcggattatggaatagtttgaaagactggaaccagggggtaagcaacaagtttgtcaacgaacttatctttctcgctttccatattgtccctgtttatgaaattgcttatctggcagacgcattggttttaaattccatcgaattctggagcggttccaaccctacagcttctatcggtgaagtaaaaacagtgcaaggagaaaatggcgaatacttggtaaaaaccaacgaaaacggttataccattaccaaaaaaggagaagacaaatctgtagatttggtctataacaaagaaaacaatacatggaatgccgtagccgacggacagagcttcgaacttgtgaaaatgaacgaagacggaacggctgttttgagcctgcaaaacggaacctccatgactgtcactcctgatgcacaaggtattgctaccgcaagaatagctacaggaaactccttgttttttgctgcaagataataaacacaacatcatttaaacacaaagaaaagaagttgcccatgcaaacaacttcttttcttccataacaatactactatgaagaagcaaatcatgctgggcggcctactcctattattaggctcctgtactccccaaaacaaagcgaatgacccgaatgcaattgacattgccgtaagtctggaacacctcacagaattaaagacctcccaattgggaaaacaaatccgttatatccctttggaaacaacagactcatccctgattggcaactcctattccatcaagttatctaaagaccatatctttgtctctaccaacggacgatgcctgtcattcaacaagcaaaccggaaaatatcttggcagcatcgggcacaaaggagaagatccacaaggctacagcaatgccaactgctttattcacccccataccaacaatctctacttttatcgccaacccgacaagttggtaaaatacgatacaaaaggtaactatctagggcaagtacacctaccacaaaagatttccccatccctttactttactttttccgactcccttattcttgctcattatggagaaggaataggacaaccgcaagcaagtgcgttactttacttcaacgaacagggagaagtaaaagactcattgccggaatttgccaatccaggtgatcctatgggcatggaccagatatccagcatcaacgtattcaagcaattacccggcaacgccaacataggagggttaatatatataaattatcaggatggaacaatgactgttcttcctatagaccagccttcactttggctgaacaacggcagcatacgtttcagaaaagcgttcaatgacacaatctacgacattaaaggacacgaagctactgtccataccactttccataccgggcaatggcatttcccggctgaaaaaatgggacaaaaagaggatacagacaactacatcgttataaccggtattctggaaactccccaacatctcttctttatatctctacagggattatacgacaagagaaaacccttctacggtatttacgacaaagaaaaacatattacttatatgaatgatgccaatgtggggctgacagatgacctgacgcatttcatgcctttctatcccatcacttgtacagaagaaggagagtatgccgctttattggagatagggaaaatagacgaatggatggataaaaatccgggaattgtccaagaaggaaagctaagctttttacaggaaatcaatgaagaatccaatccggtttgtgttatagtggaaccttgacaaccataaaagaacgctgctttcctcacggagaacagcgttctctttcttcaacacgttgaagataacagtatgctaaattagtcacgacctccacccaatgcctgatagagattgattacgccttgcatttcagtaaaacggttagcaacctgagttaactccgcattaagcaaagtctgctgagccgtcaaaacttccagataagtcgtattcccatgttgcatcagcaaagaggtactttccaaagctttatttaatgaatttatttgtttatcataataaactgatttatcacgggccgtctgatatttcaccaaagcctcgttcacttcacttcctgcattcaacaaagcctgttgaaaactcagtttggcttcttcttgctgagctttagctatctttagctgtgctatgttcgcacctttattaaacagtggctgggtcaacgaagctacagccgttgcaatgaacttgcccggattgacaatcatacttcctgctgaattagtccatcccgcacttccacttaaaacaatagaaggataaaaggcggaacgagcctgatttgtggcatagaaagctacttccaacgaacgctccgcactgcgtacatcgggacggttggcaagcatttgcacagggatgcctaccgggaaatgttccttcatcatataagaactgtcccatgtgcccgttctctcaatagcatgaggagattcagccaacaacaacgacaaactgttttctacctggttaatttgttctttcagatcaagaactgaagtacatatagtataatatgtagcttccatttgtgaaacggcagcttcatttgccaatccggcttccatcagagcacgggttgcatctacggtttctttccaggacttttcagtccggacagaaatggccagctgattgtccagcatcagcaaggtatagtaagtattagctataccggctatcagctgtgtccggacagcctgtttatagtcacggctctgttccagcaatgctttcgcctggcgtttcgcattacggatgcggccgaaaatatcaatttcccaacttgccgccaccggtaaagtataagtttgtacagcttttcctttgtcaaaactacttgctgtcccctgaggtgacagagcgaaagaaggcagataagccaatttggctgacagcatagcagcttccgcctctttcacacgccattgtgctgactgcaaatccgtattgttccgcaagccttgctctatcaattcctgaagccgcggatctgtaaaaatctcctgccagctcagattgccgatattatccacggtatcagcaactgccacctcttccccatacaaattatcgggcacttcggttgcaggtttatattgggtatatatgccgcagctactcagtgtgagcgctgcgacagtcagagtgatgatctgttttttcattttttctcttcgtttttgctttcgatgtggtgttgtctctcttcttttgcttctacacattcctcttgaatctgccaatcggccgccggctgaaactgaataggacgtaccttttcctgtaaatattggaatacgataaacaaagaaggtacaataaacagcaacgccagcgtaccgatcaccattccacccacagtacctgttcccagcgaactgtttccattagcacctactccactggcaaccatcaacgggaacagaccgaaaatcatagtcagtgccgtcatcaggataggacgcaagcgggctttggcggcagaaagtgcagcggaagtcaggctcatacctgccttacgacgctcggtagcgtactcggtcagcaaaatggcagtcttagcaagcaaacctatcaacataatcaaaccggtctgcaaataaatattgttctccagtcccatcatcttcgcaaacaggaagctacccatcagcccaaacggaacagacaacaacaccgcaaacggaatgaggaaactttcataaagtgcacttaaaatcagataaatcatcaagaaacagatagcaaagatgataatggtagtacctccctggtcggtctcttcacgggtaataccaccaaagtcgtacccaaaacctttgggaagtgcctgtacggcagtttcctgaacggcacggatggcatcaccggtactatacccttcggcaggcattgcatttacagcaatagaattgaacatattgaaacggctcagcgattctgccccataactgcgggtcaatgtcacaaactggctgagaggagccatctcgccattagacatacgcacaaagatattattcaacgagctttcatccacacgatatttcggatctgcctgaatcataaccttatatactttagagaaacgattaaaatttgaaacatactgcccaccataatagccggataatgtgcttagcacagcatccggagtgataccggcacgcttacatttggacgcatccacttctaccgtccattgcggataacggatatcaaaagtagagtatgccatcgcgatctcgggacgttggttcagagcacccagatattgttgagtggtattgaagaaagtgcccacatcaccaccttgtttatcctgcatatggagttccaacgcattacccataccataccccggaatcatacccggagaaatagcaaatatactggcatccttgatgtctgccgtacggccatatacctgtccgattactgcctgaacatcattttcctttccttcacgctcatcccaaggtttcagtttcagaatcaacataccaaaagagttaccctgtccggctagcagaccataacctgccacacgctgcacatgcagcacctgaggaatatccatcatgcgcttttcaatacgcatcattacgtcattagtcgttttcaatgaactacctgccgccgtgctgacattcacaaatacaaccccctggtcttcatcaggtaccaaactggttttagttgtattcatcaagaaagccaatagtactaccgaggccgcaagaagtgtccataccatccatttgcgtttgataaagaacaatacccctttcttatatcgttcaatcattgcatcgaaagcagcattgaacgctttacggaaacgtgctgcaaaattgtttttttccgttccatcctcattgatatacggtttcaagaacaaagcacacagcgccggactcaaagtcagtgcattgacggcagagatacctacggcaaccgccatagtcaaaccaaactgagtataaaaagtacccgaagttccactcataaacgaaaccggaataaacacagccataaataccaacgaagaagagatgaccgcattgctaatccccttcatcgcatcaatactagccatataagaagaacgatatcccacatcaaaacgcgcctgcaccgcctcgacgacaacaatggcatcatccaccaccgtaccgatcaccaacaccaaagcaaacagggtaatcaggttgatactgaatcctgctatggacataaaagcaaatgtaccaatcaaggacacgatgatccccaccaacggaataatagtagaacggatatcctgcaaaaatacatatacaattaagattaccaaaaaaatggcctcgaacaaggtttttatcacctcatggatagatgcatacaaaaagtcattggagctcataacctgaaccatctccacccctttgggcagatccttccttgcttcttccaaaaaggtatcaatattattgtttacttctgtcgcattcgatcctgccgtctgaaaaatcatacaggaaataccaggatgaccattcatagccccatgataggcatagctttcctcgcccatctctatatcggcaatttctttcagcttcaacacttcgccattatccgaagaccggatcacaatttccccaaactcttccggagtaatcagacgccctttatacttcattgtatattgataagtttcatcagagttttctccgaatgaaccggtagccgattcaatattctgttcagccaacacttgggtcacatccgatggaatcaatttatactgggccatcacgtcaggcttcatccagatacgcatactatagtcaccccccataatcatcatatcacccacaccctggatacgaagaatagcaggtttcaagttaatactgatatagttggacaagaatttctcatcatacgaatcacccggactatatagtgagaacatctgcaaaatactggtctgccgctttgaggtagtcacacccacctgcgttacttctgccggtaactgtcctgttgccttcgatacacggttctgcacattgaccgctgccatatcggggtctgtcccttgtttgaaatacacagtgatatccacaactccggcatttgaagcggtagaagtcatataagtcatattttccacaccgttaatcgcttcctccaacggagcgataacactcttctgaagagtttccgcactggcaccaaaataagaggtacttacctgaatggtaggcggagcaatatcaggatattgttcgacgggcaaagtgaacagcccgatgatacccactaccactatcgaaatagaaataacagccgacaggatggggcgttctataaaggttcttaaattcatagtctttcttagttctgttttactttaatgggagtaccttcacgcagcaaacctacgccttccgctacaatgatatccccctctttcaatccatcgttcacgatatattcctgtcctccatttacacgggtcacactgacaggagctgattgtgccttgccgtccacgactttatatacgtatgtaatatcctgaatttcaaaagtggtagcctgaggaataaccaaacttcctttcatcgtaaccggaagaatcacatttcccgatgttccgctatacagcaacccattcttattcgggaatacggcacgcagacttgcggtacccgtattacggtctaccaccccactgatggtttcaatgcgtcccttttcgccatacatagacttgtcattcaattgcagttccacttccggcatatttttcaacgcttctgctttggaaccatattgacgggtcagagccaacaattgattttcagtcatcgaaaagtagacatacatatccgaattatcagaaaccgtagtcaacggttgtggcaaactggcactaaccaatgcacctacccgataaggcaatgtaccaatcaccccgtccgaaggacttttcacctcggtatatgaaaggttattgcgagcactgacttcctgcgccttagcctgagccaatccagccttagcggtcaggtaagagttttccgcagtcttcagatcaaactctgaaaccacctttttggcaaacaattctttcttgctgttataagtcagttcggctgtggcaagaccggctttagccgattccacattggcgacagcagtttccaatgccgccttataaggcacttggtcaataataaataagacttgccctttacgcactgcctgtccttcctccacacaaagccgggtaaggaaaccggaaacttgcggataaatatcaatatcctggcggccacggatcgtagccgaataagtagtagacaaaactttgtccgacggtgatacctttaataccgcatattccgcctccatttgtgcaacaggcgcctgtttacacgacgctgtcaaagcagcacaaccaaccaataccattagtcgcatccattttttgttcaatgtcatcatattccaatcttttaaattcggacgcaaaggtagatggaatttttcaagccgacacattcaattattagctaccattgttcaaattcggaatagatttcctattataacaaaaataatagttaattttgcatcaaaacaagaataaatatggaaatattgagtttaccagagaatgaaccgtttatcaccggaatagaagaaagtatagatatatgctccaatcagatcatgaagttagcagacgcatctatttttcattgccgtagcggaaaagcccacatagaaattgatttgcaggcatacgaagtgacggagaacacccaacttctgcttctccccggcagtatcttcaattgcacctgcgccagccatgattttaccgtttcctatattgttttttccgacacccttttcagggagatcacctcacgtctggatccctccttctttcactttctaaaagagcatccatgcattgtcatccctgaagaacgtgtaaaaccattcatcggactcagcttggtcatgaaagatctttatgaagacagggataatagtttccgcattcagatcttcaaaaatttcattcaaaacttcattctggacttctatgacaagacccaacacctgttcctgcaaaaaaagaccgaaggaataaatcgccaggaagagatattcaaacgtttcatccaattaattcataaacattgcaccacccaacgtgaggtatctttctatgcagccgaactattcatcactccccgttacctttccacaatcgtacaaaacgtatccggcaacacagccaaaagcattattgaccgacatgtaattcttgagattaaagcattactacaatccacatctctaagtattcaagagatctccaaccgattatctttccctgaccaatctttttttggccgctatttcaagaaacatacaggcaagtcccctcttcaataccgaaaccggtcttaaaacaaaaaaagctgccttcaataaagaaagcagcttttttctgtttatataggatgaatcaattattcagccaatttattgtctgaacccagcacgttaataattttgtgcttgtacagtttttccatattgtcacgagccggacctaagtacttacgcgggtcgaattctgccggtttttcagcaaaagtctgacggatagcagcagtcatagccaaacgagagtctgagtcaatgttgattttgcaaacagcagacttggcagccttgcgcaattcttcttcagggataccgatagcagccttcaatgcaccaccatacttgttgattgtttcaacttcttcctgaggaactgatgaagaaccatgaagaacgatggggaatcccggaagtttttccattacagcatccaatacttcgaatgccaaaggaggaggaaccatacgacctgtagcaggatcaatgtggcactgttccggagtaaatttgtatgcaccgtgagaagtaccgatagagatagccaatgagtcgcaacctgtacgagtagcaaaatcaattacttcttcagggtcagtataagtatgatgatcagaagaaacttcatcttccacaccggccaatacacccaattcaccttctacagttacatcaaactgatgagcgtagtcaaccaccttcttagtcaaagctacgttttcttcgtaaggcaggtgagaaccgtcgatcattacagaagagaaacctgagtcgatacagctcttgcaagtttcgaaagtatctccgtggtcaaggtgaagaacgatttcaggttttgcacaacctaattcttttgcatattctacagcaccctgagccatgtaacgcaacaaagtagcgttagcatactgacgagcaccttttgaaacctgcaaaataaccggagattttgtttctactgcagctttgatgatagcctgcatctgttccatattgttgaagttgaatgcaggaattgcatatccacctttgatagccttagcaaacatatctctagtgtttaccagacctaaatctttgtaattaaccattgttctaatatttataattgttagtgaattaaattccactgcaaaagtaatcataaatgcgctaactatggcaagttcacaccaaaaatatctcataaaaaatgattttattaactattttcttcactaaaacatacaaactgattatattgtaatgtctaccttacaatactataaaagaagaaaataaggcttttagaagaaaaaacagcccgaagttttttctatttcaaagaaaagcagtatctttgcggtccaaaatggaccattacacccaatattgtttaccagacaagtaaaaaaaataataacaataaaataatatacagaaatgaaaaaaggtattcatcctgaaaactatcgtcccgtagtattcaaagacatgtcaaacggtgatgtatttttgtcacgttcaacttgtagcacaaaagaaaccatcgaattcgaaggtgaaacttatccgttggtaaaactggaaatttctaatacatcacacccgttctacactggtaaatccaaattagtagatacagctggtcgtgtagacaagttcatgagccgctacggcaaccgtatgaaaaagtaatttgtaacttatacataagttccaaaataaaaggctgcaacccgataagtttgcagccttttattttatcatacgtatccacctttatttcaaagatacatcattatactttccccccttccattcatacactacaggttctttcctgatgtatacaaccaatttttcccgttccgtctttgccagataatccggagtagtataagtaaaagaaataataggtttgtcttctgataaagtggctttcaccaactccatatccgccttctctctaatcgcggcataagcctcatcggtcagcgtatccaccggcagataaaaagccccgacggagggaagctgaataaaatcctccttcgccagttgctgccagtccgtattataaaaacgaacttcactatcacaagccggaccgcaaacagtattcactacacaaatcacctttacagaatcattcaagggtaacagtttcatttccatagaactacttccggtggtttgcagaaacaaataatcatccgtcagtcttttcagttcagatactttgccaaaacgatttttcacttccgctttcatattgcttgccagaaaatccacacaatcctcacgatttacctttgtcaataaaggagccaccgaatcgggcatggcaataaaaagagttttcatatcctgagcgtacaatgaaagcccacataacagcatacctattacaaacaatgtctttttcatcacattttcaaattaaaatcctccaaagatacatattttgtcagcttattcccaaccgcattatatttttttctatttttgtcggactgataaccaactaaacaggaaatgctatgtatttacacaaagagttagagaccctgacacgacccgaaattgagaaactacaattggaacgactgcaaaagactgtccgccattgcatgaattcccctttctataaacaacggtttgccgaaaatcatctgagtccggaagatatccgttcattggatgatttacagaaaatcccgtttaccaccaaacaagatctacgtgacacttatcctttcggactggcgtccgtacctttggaaaaaacagtccgccttcactcatccagtggaacaaccggaaatcccactgtcattctgcatacccaaaaagaccttgacgaatgggctaatgcagtggcccgttgtctttatatggtaggattacgtccgggagatattttccagaactcttccggctatggaatgttcaccggcgggctgggctttcaatatggtgctgaaaggctgggaatgctgactgtacctgccgctgccggaaacaccaaacgccagttgaaattcatctccgatttcggaaccaccgccttgcacgccattcccagttacgcagcccgtatgtacgaggtaatgcaggaaatggggattgatccgcgtcgtgacaccaaattgagaacattgatcataggagcggaacctcattccgaagaacaacgccgccgcatcgaagatatgctgggtgtaaaagcctacaactctttcggcatgtccgaaatgtgcggtcccggtgtggcttttgaatgccaggaacaaaacggattgcatatatgggaagactattatatcgtagaaatcatcgaccccgacacattggaacctgtgcccgagggtgaagtgggcgaactggtactgaccaccatcaaccgcgaggcgatgccgttattgagataccgtacccgtgatctgacccgcattctgccgggggaatgcccctgcggccgccatcacaaacgtctggacagaatgaaagggcgcagcgacgatatgattatcctgaaaggggtcaatatcttccccattcagattgaaacgattttattgcaattcaaagaattgggcagtgactatctgatcacactcgaaaccgccgaatctaatgacgaaatgactgtagaagtggaattgagccaactgttcaccgatgactatggacgcctgcaagcattgacccgggaaattacccgccaactgaaagatgagatattggttaccccacgtgtgaaactggtacccaaaggagcactgcctaaatcggaaggtaaagctgtccgtgtgaaagacttacgtaaaaccttttaaaaaataagtttatgactatacaacaattatccgtcttcatcgaaaacaaatcggggacactacagaaagtattgaacttattgaaagaagcaggcatacagctgattgcctctaccattgccgatacagtagagtatggtatttaccgtatcatctgctcggaacccaaacgcgcatacgagacgctgaaagaggcaggaatctccgtggcactctccgatgtgttcgccatcacactagacaatcagccggggcgggcggcagacgccatcaccattttcagtgaagcccaaataggcattacttatctgtattccttcctgttaggaaataaaggcatcttgattttccggacagacaatccggacagagcaagggaagtgattattcttaataatctctcttttgtagccgaaaaagatttatcaacactgatttaaagtattccttgtaggggcggagctgcgtgtccgcccccacaattatcctctgcgtttcaagaaatccgtaggactttctccgaaatattccttgtaacacttggtaaaataagaaggagatgtaaaacctacctcatacgttatctcggatatggttttctcagaagaagccaacaaagaagcagctttctttaatctggcaatacgcaccagttcattgggagaataattggtaagtgccttaatcttacgataaagctgcaccctgcttaatcccatcttactgcctaattcttccacacttaactcagaatctgtcaaatttgcttctatcagctctctgaagcactccacaaatcctttatccacctcgcttacagactctttagacaaagtaatcttatctccgaaaaactgtttcaaccgcttatggttatcaatcagattccgaagacgcaccagtaacaatttggaattaaaaggtttggaaatataagaatccgctccacattcaaacccctgtatccgctgttcatccaaagaacaggcagtaagcaacatcaccggaatatgagaagtctgtaattccattttcagcttcctgcaacattccaatccgtccatcaccggcatcatcacatcacagataatggcatcaggcacatatttcatagctttctttaatccggcatgtccgtcggcagcctctatcaccgtatattcctctttcaataatgatttcacatagccacgtacatccgcgttatcgtcaattatcaagatgcattccttattctcatccggaagccgttcttctgtttccgtctcctccaattcctccaccaccgtcggctgtgtagtgtgcggttcctgtatccgatctacagactgcccctccactatctccataggaatatccaccgtaaacactgttccttttccttccacactgtccaccgttatcaccccgccgtgtaactcgacaaaagcctttgccaaagcaagaccaatacctgagcccgcatggttcacatccatctgataaaagcggtcgaaaatatgccggatgtgccggacagagattcccgaaccggtatcagcaactaccagacggacatatcttctattttcctcctttattaaagtagaaagtgtgacagtgatagttccattctccggggtaaacttaaacgcattggacaataaattaaaatagacacgttccatcttttcggcatccaacgccatcagacagtctgtccggtcatcgttcacgtccaaaacaaaatggatatgctttctcaaagccaatgtttgaaatgcatggctccattcctgtaattgcgcacgcaggtccatattggttctcaccaactccagtttaccattttcatacttacggaaatcaagaatctggttgaccagcctcaacagaatattcacattcttatgtaccactttcaataaggatcgttgcttagaggtcaagtctttatcctctaaaagctgttccaccggatcggcaaccaaagtaagcggagtacggaaatcatgagaaacattcgtaaagaagaccagtttggcatgagtcgcctcttccaactgcttggagaggctgatcagttggtcgcgttgttcctccaattgtttcttttgacgggataactccatgttcatccggttctttgtccaatacgcacggacgatgatcgccaataaggcagcaaacagtaacaggataatcagacatgcatacagaaacatggtctgggcagagtatcttgaccaatattcgtccacctgattattcagccgttctatctttccgtcctgttcggcaatgtggtctgtctgcaactgcatgacacgggcattcgttttatcaacaagggctgttgataacttagtatcccgttcatacggacgcttctccaaaatatccatcgccacctgcatcactttatctcctccggtagggtaaataaaagtggcatccaacactccttccagtacctgctccactccataccccttgccaggcaacgcatcaataccgacaaacaacatttccttttccaactgtcgctgtctggccgacaaataagccccgacagccatgcggtcattttgggcaaaaaccagatttatatccttattgtcttgaagtatggaatccattttctccccagccacactttgcagccaggctccgtccacgctggcggtaatttctattccaggctctgccttcaaggcatccgccaatcctctatgacgctccatagccggagtggaaccttccagtcccgttatctccaaaatcttcccttttccacccaaacggttcacaatatattgtcccacatctttgccaatctcacaattatcagcacccacaaaagccgtataacggtccgacaaaatcttacggtcaattaccacaacaggtattcccagcccgtatgccttctccacaacaggagtgacagccgccgcctcattcggagcgacaatcaataaatcaactttcctgtcaataaaatagttgatatcttctatctgattccggttattatctttcgcggtacggatctccacctccaccccatcataaaacaaggcttcacgtacaatttcatgattcattttatgccgccattcgtcatcactacattgtgaaacaccaatgtaatagcgcgtatgtttctgactgcacgatgtcagaattcccataaggcataaaatcaaaaacaaaagatgttttttcatgttcctcaaggtatttatagataacaaagataaaaggtaaccgctaataaaacaaacatctgcaagagaaagtaaaaaaagaacatcgcgaagaacctgattacatctactttgtatttacaggttcttcgcgatacagcctcagacaatatgatttccaatccaatttgaatgagtatccgcaaccattaaaatttaaatcaactcattctttaaacgagccggcaactcaggcatagccccgttttgcgtacatacgtatgcagaaacctcaacagccagtttatgcgcctcggcaaccggctttcccttcaaaatagcagctacaaaagtcgccgtgaacgaatcgcccgcacctaccgtatcggccacctccaccttcggagtctctacaaatgaaatctcacccggagtaaagacataactgccattgacaccacacgttaaaatcaacatcttcagattatatttcgccaacagaatccagcatttatcctgcaagtctatgccgggataaccgaacatacggctcactgtgaccaactcctcgtcattaatctttaaaatattacattttttcatcgagttgcaaagaatctccttcgtatagaaaccttggcgcaaattcacatcgaaaattttacattgtccttctccttcgggcatcacatccagaaaacggttgattgtttcccttgaaaccacactacgctgtgccaacgagccgaaacatacggaacgggtattctttgccaactcttccaaagcaggtgtaaaaggtatattatcccaagccaccccttcttttatatcatacataggtaccccattagggtccagttccacctgtacggttcctgtgggataaggcactttctctatctgatacttcaagttcttaccatcaaaattctcaagtatctcattacccagcttgtcatcgccaatcgcactgaccacccggctgtcaaaaccgaattgtgacacatgataagcgaagtttgccggagcaccaccaattttctttccttcgggcagcacatcccatagtgcctcacccattcctacgatgatttgattcatgatattatttactgtttacaattaaaatcatttctttattttcaaggtatacatcaacaaatagataactccgacagtcatcaccgccacagcgccactctgccccatggcatcaccggcaactcccatggccaacggaaataccgtaccgccgaacagccccataatcatcaatccggaaacttcatttttcttttcgggcatggcaaacaatgcctgcgagaatataatagagaacacattggagttaccgaaaccaatcatggcaatgcaaatataaataattgtttccgaatggaatataaataatcccaccattgccagcaacatgaacacgacactgagagcaaagaaagactttgcagaagccttttgcaagataaaggctccgaggaagcaacccaccgtacggaaaataaaataaagacttgttgcaaaaccggcctcagccaatgtcatatccaaacgctccatcaagattttaggagccgttgtattcgtaccgacatcaataccgacatggcacatgatcccaatgaaagacaagagaataaacggttttcccaacaaggaaaagcacgctttgaagccggacgctttatcgggtttctcttcctcaataggggtcagccccaacaacacgatggcaaaaacggctatcaccatataaacaggaaataatacccgccagccaagcccgaaagtaggaatagcctgcatcgctccccacatggcaatgtaaggggcaagaaaggaagcaatagcttttacaaactgaccgaaagtcaatgtacttgccaacttttcccccgcaataatattactcagcaacggattcaaagaggtttgcatcaacgcattaccgatacccagtaaagagaaagaaatcaacataagcgtatagccgtcgccgaatatagggagcagcaaagaggcaaaagtgacaatcagactcagaagaactgtcttcttacgccctatcttattcatcagaatacctgtaggtacggagaaaatcaggaaccagaagaagaccaaggaaggaaatatattggcttgagagtctgtcagatccagatccgcttttacataattcgatgcaatccccaccaggtctacaaatcccatggcgaagaaacacagcatcaccggaattaatttggcatacagatttttattgctattcatgactttatacttagtttacaaacctaacttatatattgtgaaatttgaaattttcatctctcctcctttactataaaaacgcaaagagttataaggttcattcgggaataccagattagtcatggcaacgcggccaccgtcaacaaacaactccacacttccattatccacaaaaacttgaattttatgtgccttcgcggtgtttatcggagcccaagtacccaaagcaaaatcatttttataattcaccgtaacctctttataacgagcataactttcttcggtatccaaatcatgcggttttaccttcttgccaaagtctacaataccgctttccgcacggtccattaccacacgtccctccgaagcatccagataaatcttcaccttctcacccaaactgttcagcaattcaaaaccagcctctttaccagccgacaccagttgcaattccagttcaaaagcgccgtcgttattttcaaaaagtgtttctaaacgcttctcgccatttactgtaaaatcatccagctttttagaatctttccgcaagtgctccgtttcctttaccggtgcggcactcagataaagctgtttgtcttctcccgtatacagactcagctcacgcggcaaagcattggcactgcggaactgttgtataggagtatagttagcatactgccagttgctcatccaaggtacggcaatgacacggtcgccggtattcgagaaacaaacagtggcataatgatctttcccccagtcgagccatttcaccacctcgggtttcgtatcacatacaaactgatgcccgtcaaagtcgcctgtaaaatacatcgtaccgctgcctccatagacaaatcccggattgatattgacaatcatcacccatttcatcctggtccggtcaccatctacaggaagttggatgaaatccggacattcgaactgattgggctgaggaccaaatccttctccaaactcactcatatattcccattgcttcaagttggcagatgaataaaaacgcatattcttatccgcactgacaatcataatccatttctgttcgggttcataccaaaagaccttcgggtcacggaaattctgtagtccgtcaaacggagtaagaaccggattctgttcatacttcgtataagtacgcccgttgtccgtactgtatgccatactttgtacctggctctgcccaccgggtatattacggtgcgaagtataaaaagcgacaattgtattttcaccgtagcctgcgctgttatgtttatccacaatggcacttcccgaaaagatatgccccaatgtatcacgggcaatcgccgggtcaagatgctcccaatgaaccaaatccttgctcacggaatgtccccagtgcatatttccccatacggagccgtatggattatattgaaaataaaggtgatattcaccgtctttataaaccagtccgttggcatcattcatccagccataaagcggagtgtgatgataaaccggacggaacttatccctgtttgccgtatcaaatgtatccgaaacccggatgctgtcccaacacagcgcatctgccgccaccttctttataatgacagtagcttcctcacttccctgaggcaaggcaaacggaacataatattcaacgctgtctgtagccagacgcacatccatatcggtatctgcggggctcccagtatccagccttaccagtccttccttgctgctctcctgaatcggaagcaacaaatagttagcgggacgggcaatatgtacgattgtcaccgtatctccctgatgttcgaaaaccaggtcatttttttgtgactgacaagaaacagcgcctcctgtaaaggctaaacctaatgcaaggttaacaagatttgttttcatgaagtataggatattaaaagttttgtttgattgtttttcgttatcggcaaagttaacggaaacctgccttaccggctgaaacatttgtttcattcttatgtataaatgttacttttccaccataaagaagaattaaatccctcttgaatcagaatgttattttcgccgcaaattctacggtgaacggacggatatagctgcctgccatccatgcgccgttatatgccgccgcattctccttatctaccagctcggctcccgaaatacttcctttcgccccggtctggttcaagaagtttatcacagttccgcttaaggacaaatgtttgttcacattccagtttattccaccgaatgtttcccaacggccgttgaaataataggcatttttaatatttgcatacgtcttgctgaagtaacggaaactggcccataccttcaagtctttggtaatgttgtaactagggtccagttcaatcagcaccttcggaatttcggtaacgatattgccggtggcattgatacccgatgttgtcccgtcactaaaggtcactcccgtttcatacttcttatacttcgggctttggtaagtgaacaggaagtggaaatcaaatcctttgaaaggtttcaccaccgcatccgtcgtccaccctattgtttcaatatcataactcaatgcggccgccttaatatccttatcattattcggattaatcagattcaaggtagagttgttgttagtcttggcaatgtaactgaacagtgaggtcagactaatccagtcattattgaaataaatacccgcacgccccaacggaattgtaatcttatctacattcggcatctcggcaggagcaaagttcgacatattcggccgctgggtattgtaggtgaaatcggcggtaaagccaaactgctttgtcattttataagtggcggcagccgtgaaagccatgttcagccaattgtaactgaaataacggggagctatcttcgtaccatcggctgcaactgccccgatatgataaccggcaaagcggcctaccggattgccttcggcattatataccgccaggttctttcctgccagacgctggtactcgaagcgtgcgccataatacacattccatttatcggtgatgtcccagtcgtgagtagcataaagagccagtttgttttcatgtcctttgtaatattcggaagcattctggttcagattataataaggagtgtttccgtaatgatgaatatccttcgtatcagcgctgtacaacatttggggatattcttccaccgtatggtcatacatggtagtgttcgaagcatagtccacatcataataccattcgttcacccccacacgccaagtcatatcatcatacttccgcgacaactcggtggtaaagaagaactcatctatattcccccggttgaaacaggacatgcggctctgtacatatccctcataaggattcaatgttccatccagtcctttggtgctatagccgtcggctcctactttctgctccatagacatcggagtctggtacagataggaacccaaagcatggtcatacttcatattgattttccactccaacccgttatcccaccggtaacggttcagaaccgtcaactgatttcctttactggccgtagcatcatacagactgatctttttcatctcgccggtacgcatgtccatataaaccatatccgatacattgggcagataagaagaagtccccagtccgaaaccgggaatttccttcacactcccatcgcctacataaataaatggtgcaccggtggtagcattggacaaccaatggctgttgctgtaatggtagatggcagagagctgtccacgtccttcattgtagaacttggtcaaggcaaacttatagatctgagtccggtcctgatattgcgcaaaacgcagtttgaacgaacccggatcaaaattctgatagatgctgccgctgtaaaaccaatcttttccgatgcttccattcagattgaagtcaaattgctgtttaccgaaatgattggtgccgtagttcagcacaccattcattttcttctctttatccaagccgagttccgtaaacgaattgacagcataacctatattaccggtagtaatcgctgtttcggaaatcttcagcaatccggtatgtcccaagctgctgtctccgcgccaatgcgtgtttacattatgaggattcgaattatataccacaggcagaccattttcgagtacattcacatcaccaccgggcagaccgatagagatttcacgaggaccattggcactagccgcattcaacatgacattgcgattgccttcctctttcgaatcagaggacactttggtagaatcttgttgtgcataaccattcaagcaagcggcggcaagtaaaataatgaccgcgcccatccggttcttttgctgatttttgttcatagcattaaatgtttttagaagtttttctgaggcaaaggtaggggacagccggcaacctctataaaacatttgttacagctgccggcatttttgtttcattgcaacaaaagtgacggattatgtaacatttctcgtgaaccatacgccttttcacctctaaaaacaaattcatgccaattttccttcagccttcagtttgggctgtttttccccattccatcgaagaaaacacctgaaggataatccttcagcctactgtcagcccgcctcctctttttctatccgaagtatgccggtaatcagcataaaacacttacctttacagcacaccaactgaaaagaaagacaccacaatgaaaggaaaacccctcaaaccttcaagggaaacatctaatttgcccgtacaagctcttttctcctatgaattaataggtttttccagtatgattaagtacttttgtcctgaatactaagacagactccgatggcagactgtacaatccactatagcagaccgtacagtccactacagtaaaccgtacggtccattgcctgcgtctatagaagttaatagaaagaatccccttagcgttcagcaagaaacgacttaatctccctattaaaaagcattaaacatggcagcaaagtatgatttcaaaacctcccccgacatacagggagagaaggaacagcccaccctgtatccgcaaattgtagtatcgggcacaaaaaacctgaaagacctggctaaagacatcgcccggcgttctaccgtccacgaagggaccgtcgtcggtctgttatgtgacctggaaagcattatcgccaattacctggcagacggttataacgtaaaactgggagaactgggcacattctcggccacactgacttgccgcaaggtaacggacaaaagcgagatacgcgccgcatcggtacattttgacaacataaagttcaaacccacccggaaattccgtaaggaggtacgaagcaaaggaaagctggaacgggcggaatatggtttccggacctcctccacccgatattcagcagaagaacgctttgtacggctgacaaattatctgaaagagcactccattatcacttgcaaggaatattgtgccttgacagggttgctgaaaacaaaagccggcagcgaactacgccaatggagcagcgaaaagaaaatagaaagaaacggacgcgccccgcacgtgatatacagggcgatgccggaaggctgaaaaggtatcctttcacctgcttcccccctctcccggaacctttattctttccgggtgcggctggtggctatgagatacgcccccagcagaatcagcggcacactgagccactgccctatgttaaaagtcatatccgcctcttcggcaacctgcggattcttcataaactccagagcaaagcgagtgccaaagaatataagcaagcttactccggttattaatcccaccctcttttgtaaatggtatgtatggtacatcacccaggcagttacaccggcaaccaggcaatacagcatttcataaatctgagtaggatggcaaggcaaaccttcatacagctgatgccactcccgggaacggacaaattcaaatccccaaggcaacgtggtgggatatccgaatatctcggaattcattaaattaccaaaacggatacagaagcagacaatcgccacagcaggtatcatgcggtcaaacaaccaccacacacttttccgggttacttttttcgagtaccacatcagagccagaatgatggcgaacacccctccgtgacttgccagcccgcctttccaaatcttgaatatttcaacaggatgggcgccataatagtcccattcataaaacaaacagtgccccagacgggcgccaatgaccgtactgactatgcaatagacaaaaagcttgtccacccactcttccggatacttctcttttttgaataaacggcttaccatttcataagccaatatgaaaccaaggccccacatcagcccataccaacgcacttcccaactacctactttaaataagataggatccacatcccatacaatacttgctatcattgttctatttctttgtttatgaacacaaaggaaataaaaaaatctcttctccggaataaaacagagaagagattttcagaatatcgttctttttgaggaaacctctttataccaaatgggcaatcagttcctcacggtcgccgcacagcagatcaattacaggaacttcgatcatggtataacatccgggctgctgtttcatggaggcgcgtgccacgcaaaccagcacctgcgcggtaagagccggattattaatcttcatgtcaaactcgaacaactgattgtgagtcttgcccgatacccctttgcgaaccaggttaacgccatgacctacgtcgttcaaatcgtccacacatggaacttgttttacatgtgtctcgtcatttacaaaataaggatccgacttgatggcggcttccacagtcttgaagtccgcaccttcctccagttccacatacaccatacggcgatggataccggttcccacaggaatagtcatggacaaagcatccttcactccatcaatggcacggactgctacggaatgccccatgctgcgtcccggaccgaaattggtataagtaatacccttcggagcgatggcttccagcagtgtacggactacagaatcgcttcccggatcccatccggcagaaataatagcgacagccttaccggcctttgccgactcatccaatgaacggcggagagaagtgatttgcgtatgaatgtcgaaactatctaccgtattgatacccattgccagaatctctttcgcatattcttccacgctacgggtcggagtagccagcacagccacatccacatctttcaattcctttatatctttcaccacagcgtatgcttccaactcggcaggcttgttttccgcaccgctacgacggacgatacctgcaatctcaaaatcgggagcagcttccaaagcctccactacatactgaccaatgttaccgtatccaaccacggccgctcttatttttttcatcttttattgggtttagtttactattatctgttaattcgctgcaaaaataaacattttgcctcgtttttttgttcactacgacctaataatttaaaaatattcttgccgaacttataatttaaaagatagatgtcctatttttgcaaagaactgtaaattttcaaatgaaacaaccatgatagaatatattaaaggagacattgcggagattactccggcaacggtggttttagattgtaacgggatggggtatggcatcaatatctcattgaatacgtattcggccattcagaatcagagcaatacgaaattatatatttatgaagcgatccgggaagacgcctacgtactctacggattctcgaccaaacaggaacgggagttgtttttgttactgatttccgtatcgggcatcggcggcaacacggcacgtatgattctgtcggccttatccccttccgagctgtgcggagtaatcagttccggtaatgacaaattattgaaaacggtaaaaggcatcggcctgaaaactgcccaacgcatcatagtggacttaaaggacaagatcgccacttcgggcgtggagacggtgaacagtgaaatgtttgccaatccgggcaatacggaaattcatgacgaggctgtcgccgcactcaccatgctgggattcgcacaagccgcatcacaaaaggtagtggctgccatactgaaagaggagcctgccgccccggtagaaaaagtgatcaagctggccttgaagcgattgtaagggccgtacatgaaacaaggaacacggacaatgcggactttggggaggttctcttcaggatccgcattgtttgtgttcccatccacatcacttctcttcctcctgttcctgcattttgcgggttacaaactctattttcaagttcgcttctttcttatctttacggatttgttccatgccggacaggatgcgcgccaactccgtcaattctgcaatcgccttacggtcattgggttgcatagccgttttataagtacgatctccgataaactgaagttggatattcttatctttgttcgctacaataaaagcgataacgccgccgtcttcccccatcttgtaatcggccttctcgattgcacggcccaagtcagtggtttcatagctgtctttcgaggcgggagtttcggcaaaggtatcccccacactcactttcaccgccgtgtgatgcaacgtgccgccagcacaataaatagaggtaagggacatttccccctgctcgttcacttgcccgcgcaagaatgaacggcctatattcttttctactgtctgggtgggataaaaatagttacccacctcctgatatgcagtatctttctcaagaacaaaattacccttgacggaatccagctgagcttgtttcaccaccatcatgctatccaggtaaatcagacttttccgctgttctttcaaatccacctgctgcatcagcttgactccctgttttctggcttcaaacgctttcggataaaggatgcggatactgtctatctgcaatttggcctcattaaagttctctttttctaaagccgcttcggccttacgcaaattttcttgcgctttcttctcgccgccatcatcacaaccggccagcaacaaggcaaataatgctactaatcctatctttttcatgtacttgatcgttttatatgcaggcaaaaatacaatttaattgcgtgatttctccttatcctgcgcaaaaaatcgtaaatttgcccctctttaagatgaatatggaactaaaagaacactttaataataagatattcaagttaatctccgaaacggcagacgaactgggattggaatgttacgttgtaggaggttatgtacgagatatattcctgaagcgtccctcgaaggatatagatgtagtcgtagtagggagcggaattgaaatggcacaggccttcggcaggaagctgggacgtggggcacacgtttctgtttttaaaaacttcggtacggcacaagttaaataccatgacacggaagtggaatttgtcggtgcccgtaaagagtcgtacagccatgacagccgcaagcctgtagtagaggacggcaccttggaggatgaccaaaaccggcgcgatttcacgatcaatgccatggcagtgtgcctgaacaaagcacgtttcggtgaactggtagatccttttaacgggctggacgatttgaaagagagaactatccgtacaccgctggacccggacatcactttcagtgacgatccgctccgcatgatgcgttgtgtccggtttgccacacaactgaacttctatattgacgacaccactttcgaagcactgtcacgcaacaaggaacgcattcatattatctccaaagagcgcatcgccgacgagttgaacaagatcctgctcgcccccataccgtccaaaggctttatagaactggaccgctgcggactgctgcctttgattttccccgaactggtggcgctgcaaggagtggaaacccggaacgggcgtgcccataaagacaacttctatcataccctggaagttgtggacaatatttccaaacataccgacaacctatggctgcgttgggctacgctgttgcatgatataggcaagccacgtaccaaacgctgggagccacgtataggatggactttccataatcataactttatcggtgagaaaatggttccggatctcttccgcaagatgaaactgcccatgaatgagaagatgaaatatgtccaaaagttggtcagcctgcacatgcgccccattgttatcgcagatgatgtagtaaccgattccgccgtgcgacgtctgctttttgaagccggagatgatattgacgacttgatgatgctgtgcgaagcggacatcacttcaaaaaatgaagcacgaaaacaaaaattcctggataacttcaaactggtacgccagaagctgaaagacctggaagaaaaagaccggatacgcaatttccaacctccggtagacggagaagaaattatgcggatattcgacctgcagccctgccgtgaaataggcagtctgaaaagttctatcaaggatgccatactggatggaatcatccctaatgagcatgatgctgctttagaacacatgttgaagaaagcaaaaagcatgggattaactccaaaaaacttataagaaattgaccatacactataccaaaggagaagagtgggccaataccctgtcacatggcgttggtatcctgataggtatcgccggcggcggttatctgttgcttactgccatgaaaagtggcaatccgtgggcaacaggcggcatgtggctctacctattcggtatgctgtcttcctatatcagctccacctggtatcatgccagcaaaccatctcctcaccgcgaagtgttgcgcaaattcgatcatgcttcgatttatctgcatatcgcaggcagctattcccccatcatgctgatagccttgcgggaagcagattattggggatggggaattcttagtttcgtatggctatgcgccctcgccgggatcattctatgtttttgtaacctgaaagaacatagcaacctggaaacaatttgctatatagccatgggatgcagcatttttgtaggtttcaagccgctctgccaacatgtgcctcccgcttttatttattggttaatcggtgaaggagtgtcttacatcaccggagctgttttttattccttccccaaattgccctatatgcactctgttttccatctgttcgtattaggaggaacggtctgccacatgatggcattgtggtacattttataaccttcccatcttcaataagttatccgttttggaaaacttttatccattttttaaatagaaagtttcccaaaatgttatacctttgcagctgtccgacaaggtgaagttaaccacttccaagagggaatgccgtgaaaatcagcaacagtacccgctgctgtaattctcgtagagctgaaacaatatgccactacaaaaccatttgcgggaaggcgttttaagggagagataagtcagaaaacctgcctggaaggacagccaagttttttaaattaacaattaatttttcaaacaatgaattacgctgagatttgtattattaagcgtgatggaaagcgggaagacttttccatcagtaaaattaaaaatgcaatcggcaaggcattccatgcctccggaattgacaatgaagacaaactgattgctgaaattaccatgcgggttatcagcaatttcgtatctccaaccatcagtgtggaagagattcaggatctggtagaaaaggaactgatgaaagtacgtcccgaagtggccaagaaatatattatttatcgcgaatggcggaatacggaacgcgaccgtaaaacgcaaatgaagcacatcatggacggcattgtagccatcgacaaaaatgatgtcaacctgagcaatgccaacatgtccagccatactcccgccggacagatgatgacttttgcctcggaagttactaaagattatacctataaatacctgttgcctaaaaaatatgccgaagcacatcagttgggcgacatacatatacatgatttggattactatcccaccaagactaccacttgtatccaatatgacctggatgacttgttcgaacgcggcttccgcactaaaaacggaagtatccgtactccacagtccattcaaagttatgccactctggccaccatcatattccagacaaaccagaacgagcaacacggcggacaggctattcccgccttcgacttctttatggcggaaggggtacggaagacatttcgcaaacatctgaaaactttaaccgagttttatatagaagtagagggaaaagaacccggaacagaggctctcaagaaaattgaagagaaagcatacgccatgacacgcaaagatacacatcaggccatggaaggattcatccacaacctgaacaccatgcattcgcgagggggaaatcaagtcgtgttcagttccatcaattatggaacagacacttctcccgaaggccgcatggtcatagaggaactgctgaaagctaccatcgaaggcctgggtacccgtggcgaagtaccggtcttccccatacagatattcaaggttaaagacggagtatcttattccgaagaggactataagaaagccatggaaaacttcgaagcggcactggaaggcaaaatggaattccaagctcccaatttcgacttgtttctgaaagcctgccgtaccaccgcaaaagccttgttccctaattttatgtttttggatactccttataacaaaaatgagaaatgggatatcaaggaccctaaacgttaccgctatgaactggcaactatgggatgccgtacccgcgtatacgaaaatatagcaggtgaaaaaagttcattaggacgtggcaacctgtcattcaccaccatgaatatgccccggctggccatcgaagcacgcatcaaggcagaaagtctggaagagtcaggcaagaaagaggccatagaaagaaaagcaaaagaaatattcatggaaagtgtacatgctttgtccgaactgattgccgaacaattgtatgcacgctaccagtatcaacgtacagccctggcacgccagttcccgttcatgatggggaatgatgtgtggaaaggcggaggaaaactttcgcccaacgaccaggtgggggatgtattgcgtcaaggcacattagggataggctttatcggcggacacaatgccatgatggctctttatggagaaggtcacgcacatagccagaaagcatgggatacattattcgaagccgttacggaaatgaataaagtggcagatgaatacaaacagaaatatcagttgaatttctccgtacttgccactcctgccgaaggactttccggacgcttcacccgtatggaccgccgcaaatacggcatcattcccggcgtgacggacaatgactattatgtaaactctttccacgtagatgtaaaagagcccatcaccatcaccgagaagataaaacgggaagctcctttccacgccattacccgcggagggcatatcacttacgtggaactggacggagaagctcagaaaaatgtaaaagccatagccaagattgtaaaagtaatgcatgacgaaggcattggatacggttccatcaaccatcctgttgatacttgtcaggcttgcggttacaaaggagtcatttacgacaagtgccctgtttgccagagcgagaatataatgcgaatgcgtcgcattaccgggtatttgacaggcgacctcagcacttggaattcagccaagcgtgctgaagaacgtgaccgggtaaagcatggataatcagcatgaacttgttatttacctatcctgaaacaatagtcgacggtgaaggcatccgctattccatctatctggccggatgccgtcaccattgtcgcggttgccagaatcccgaatcctggaatccatcggcaggcactccgctcacaccggaaaaaatagaaaaaatgatctgcgaaataaatgccaatccattattggacggaatcaccttttccggtggagatccactttatcatccccaagaattcctggctctggtcaaacagatcaaagaagctaccggacaaaacatctggtgttatactggatatacatttgaacagatacaaaacgatgaaatgttaaaaccgatactggattatgtggatgttatagtagacggacgatttgagccggatttgtactctccttacttggaatttcggggcagcagtaatcaacgcatcatccgtgtgcgataacgctaaaagaaataaaaaaggggtgttttcttgatatatatcatgaattcacccttttttatgtttttcagcatatatttacttgctaatttcaagaaaagccgtacctttgcaatgtggttgtgaaaccaaatattaagttaataaagaaaagaacaaaattaggtattaagtattaaggtaaagattttaatttaaggtattagatttaggtaaagaaagattgatttagaaaggtattagtagtaagatttaaggtaattagaaaaagaaagttttcaggagattagttttataggtattaaaagagttgttttttttaggtacaagagagagaggataacacaactgagacgagaaagatgaaaagaaccccataatggaggggggttcttcaggatgtgagcgggtttgataaaaactttcgctctttttttatgtctttttttcaccacgggagagaaacaatataaaaaacgcagatttccgcaaagacgattgattcaatctttgcggaaatccgtgcctatcggcattgttataaaaatgccgtgtccttttctgtcatgcagacctagaacaagaatcgcatgatatcattaaagttcgcccaaatgagcaaggcaaacagtaaaaacatacctaccatctgtgcatattccataaacttgtcactcggcttacggcgggcaatgatttcataaagcaggaataatacatgtccgccatccaatgccggaataggcagaatattcataaacgcaagaatgattgacagaaaagcagtcatttcccaaaaacgatgccaatcccatactttcggaaaaatacttcctatcgttccaaaaccacctacgctcttggctccttccttagtgaacacatatttcatatcgttcacatatcccttcaacgtatttacccccaattgcaccccggcaggaaaagattcaaagaaaccaaattcacgggttgtttctttataatcagccaatgaagagaatgttgcacccactctaaacaaagagtctgtacgcaccgtcacggtgtcacgcagtccgttacgcgaatataccatttgtagagaagcatctttatctcctgtagcttccgcatcagcctgcatattatccagtttttccaccaatgcattccatgagttcaacctctcgccattgaccgcgaccagactatctcccttctgtataccggccttatccaagccaccgcccggtatcaccgagtcaacgacattaggaactaacgccgtaacaaacatcggatcatcctttgctatatccaacaagctgatctcaggcatatatacttcggcttcctttccgtcgcgcaatacagtcactgtacgtgcctcagcaatatcacgaagcatatccaccccgaaacgctccaatggtttttcatctgcacgaagaagaatatcaccgtcacggaaacctatttcccgggcacgctcattaaatttcataccatgagtcatgtcttgcagcgatacaaaagaatctccccaatggaataaaatcatggaatagatgaagatagccagcaagaaattcatcaagacaccacccaccatgataagcagacgctgccaagccggttttgaacgaaattcccatggcttagcaggctgtttcatctgctcggtatccatagactcgtctatcatacccgaaattttcacatatccccccaaaggcacccagccaataccatattccgtatcactgttcttcggtttgaatttgaacaaagaaaaccacggatcaaaaaatatgtagaacttctctactcttactttaaaaagacgtgaaaaaagaaaatgtcctccctcatgaataatgaccaataatgaaaggctcattatcaattgaagagcacgaatcaaaaatgtttccatctaactatttactattttataatttataattaacataattctctgccaactaccatttaagatgacaaaagggacaacgctacccgacgcgcctcagcatcagtatccacatagtcttcataagtcggttccttgatataagcaactttacccatagtctgttctatgacatcactcatacccaggaaagatattttgtctttcaggaaagcatccaccaccacttcattagctgcattcactatacagggcatatttccggcccgatacaaagcctcgtatgccaatgccaaattacgaaaacgtttggtatcaggctgttcaaaagtcaggtctgttatacgggcaaaatccaaccgctcgaaagaagatttcacgcgctccggatacgaaaaagcatattgaataggcaaacgcatatcgggcatgcccaactgtgctttcacggccccatcctcaaactgcaccatagaatgaatgacagattgtggatgaactaccacttcaatttgctccggacgcattccgaataaccatttagcctcaatcacttcaaaccctttgttcatcatggaagccgaatcaatggttatcttcgctcccatctcccaattgggatgcttcaaagcttgtgctttggtcactgtttgcaactgctccatggtataagtgcggaacggccctcctgaagctgtcaagatcactttctccaaccggttatttatttccagacactggaagatagccgaatgctccgaatccacgggaagtacaggtatatggtactgatttgccagtgcattaatcaactccccggctacaaccagtgtttctttattagccaaagcaatagctttacctgcctttatcgcatttatagtaggacgcaatccggcataccctaccatagaagccagtacaatgtcaataggttgtgattccacaatttgagaaagcgcatccgctcctgcatatactttgacaggcagatcactcagcgcctctttcaattgaaggtatttttcctcattggctatcactaccgcctcgggcatgaacttacgggcttgttctaccaataaatcgaccctgttattggctgtcaacgcatagacctcatataaatctggatgttcctctattacctgtaaagcttgtgtaccgatagagccggtagaacctaatatcgctatttgttttttcataatgttgttaaaatacaatgtattttgagggatcaatcgcacgtcccttatgccataattcgaaatgcagatgcggtccggtagttttttcaccggtatttcctaccaatgcaatagcttcaccacctttcaccggatctccttctttctttaataacgaaccacaatgtttatacaccgacacaaaatcctgtccatgctgtatctgaataacataaccggtttctgccgtataagtagacaaaatcactgtcccatccaatgttgccaacacactttcatttggattagcggcaatgtccacaccgtaatgcctgttctccaagtcaaaattagatgacatcatgccccgtgtaggacgatagaatatcaatccggaagcggcattattatcatcaacagccgtcagattatatcgttccgattcttcatattgcttgcgaaactcttcttcctgcctggtacgttccatcaaagaatcagaacgaagaatggtcagagagtcgatagattggactgtatcagcttttactttcccgctaaatatatcctgaatgttcatgatatacatattctgcctcgtcaccacttgttgtaatgaatcggcccgcaaggcattggtcaccacctgcgcacgtacctcactgttcatatatcccggcaaatagttacgtaaaggagtaaaaacaatgatagttgccgaaatcaggaaaattaccgttacggcagacagcaatacagacacaccattgagtttggaaacgtgcagtcccacaatctcctccaacgtattttcattggtaatggtcagtttatacttaaacttgaaattatgccaaaatgctttccttccttttttcttcattgtgcgcaccttctatatttatatcaagccatcaggtacttcgaccgtcagcaaacgctttttcttatccaatttgatgataaattcctcgtgggcaggcagcaaaagttcctcgccatccttctcaatggcaaaaaggacattcatcgtactgtcatccaccgccacaatctcgcccaactcaccatgattcacatcttccaccttaaagccaataaaatagttccaggtaggtatatcatccgaatcttcctcctcaccgacatatttcttcgggaaatagacctctacattcgtaaacatacgggccttttccgaggtatccaccccttccagtttgactaaagcagtggtatctgaacgaaaacgatactcttcaataaagaaaggcacgaatataccgtctaacaaacagaccagatactcacattccacacggtcaaaaatatcatccgtaaaagtgaatgagatttctccttttactccatgcggtttgttgaatataccaatcttgaaaacttcatctttcttaatcatgattgatttctctaaattctagtaatacgtgcgccaagcgcattcaaacgctggtctatattctgatatccccggtctatctgctctatattgtgtatgcggcttataccgtcggcactcattgccgctatcagcaaagcgataccggcacggatatcgggtgaaatcatatttccggcgcgaagctggaaattacggtcatgccctatcacaacggcacgatgagggtcacataatataatctgtgctcccatatctatgagcttgtccacaaagaacaggcggctttcaaacatcttctgatgaatcagtacactgcctttcgcctgtgtagccaccaccagtaccacactgagcaagtcgggagtcagccccggccagggagcatctgctatggtcataatagagccatcaataaacgattcgatctgataatgttcctgctcggggataaacagatcatctccccgctgttccactctgatacctaaacgacggaaactttctggaataatgcccaaattttcatgcgatacattcttaatggtaagctcacttcctgtcatagctgccattccgataaaactacctacttcaatcatatcaggcaacacccgatgcgtacagccatgcagactttccactccttcaatagtcagcaaattagatgcaataccggaaatcttcgcccccatgcggttcaacatacgacaaagttgttgcagataaggttcacaagctgcgttgtaaatggtcgttttgcccttcgccaggacagaagccatcacaatattagccgtaccggtaaccgaagcttcatccagcaacatataagtaccttccaaatgctctgtgcaaatactgaaaacacttcgttcctcatcataattaaaacaggctcccagtttctgaataccgataaagtgagtgtccaaacgccggcggccaatcttgtcaccgcccggttttgaaatcaaagcccttccaaaacgggcaaccaacggaccaaccaacatgactgatccacgcagactggaacatttctttaagaattcatcactctccaagtagttcaaatccacagtgtcagccttaaatgtatatgaatcaatccctgtttttgataccttgacacccatatcacgtaacaactgaatcaggttgttcacatccagaatgtccggaatattagttacggtcacttcttccgaggtcagcagagtggcacaaagaatctgtaacacttcatttttagcaccttgcgggtgtatttcgccgtgcaatttatgtcctccttcaattacaaacgaagccatggtatcattttttaggaattaatatttctttctttggttgttgttttgttgcggtctgcgctgattgttgttctgttgcggcctgcgtggaacataaacacgttgttgttcattcaaatgcaggtcttcaggggtcagattaatcattcccttagagtaatcgcgaagatcatccaagattttctgatcctccaccccgtctttgttccagttcaggaaacatttcttcatgtggtttgcaatcaggctgatcagctgcttcttctcctcaccttccggatagtccactgcctttttaatcatgttctccaaaatacgtccataatgacggtaacggattccattatgcggataaggcaacatatcgggtttcacctccaggctttctttcttcacaatttcatacggataatcgatatccagcttgaaatcggccataatagccaaatgatcccataatttatgtttgaaatcgggcacatcccgcaaatgcggaaacataccgcccataatgttgataatcgtattcgcacaacgttggcgctcagctctgtcctcgatggtcaaggcgtggtctaccatgttctgcacacttctgccatattcaggaaggggtaaagttcgttgttgagtattatactccatatatatttaaaatttatgatttatgcactgatttgttcatcggctgttacaaaagctttttgggtttggaagctacaaactctttcaaatagaaaggctcaaaataagccacatccttaaagttctgccttaccatttccttttctgccaatgggaacatccatttacctaacggacggatgtcatcaataaaatgagcattgggatgagtaatctgcccacggcatttggctgcaccgttaccaaaaaaatagaccggatgttcattcaggaactccaaataggaatgctcatcaacaatatcggcggctatttcccttttcacgcccaatgcgcgatcataaacagctgcatagacttccatgcgacgtgcgtctatcataggacagagcaaggcatcctcaggcaaatcatgatgtaacaacaccggcacacacaacacctccaatgtcggcagaccgataagtggcaaattacgtccatagcaaatacccttcgccatagaaacaccaatacgcagccctgtgtacgagccgggcccgcaactcacagccactgcatccaacggcataccatgactgtcgacaaaagataaagcctcatctacaaatacgcccagctgcacggcgtgtgaaggtcctttcaaatcctctttggagaacaccgccaatccatcctcactgacggcaacagagcaggcctctgttgaagtttcaatatgcaaaatacacgacataatgctctacttatataatataatctgcaaatatacacttttatttatacttcatttccataaaaagattacttttgcaaaaaaacatattagttatgatacagtcaatgaccggatacggtaaagcaaccgctatattcggagaaaaaaaaattaacgtagagatcaagtctttaaatagtaaagcaatggacttgtctacacggatcgctcctttataccgtgaaaaagaaatggaaatccgcaatatgatttccaaatcattggaacgcggtaaagttgatttcagcctgtggatagagaaagacgtttcggatacagccactcccattaacgccgcccttgtagaaaactactacaatcagataaaatctatttccgaaatgacccatataccaatgcccgaagattggtttgcaacccttctacgaatgcctgacgtactgaccaaagccgatgtacaagaactttcggaagacgaatgggaggtagtccgccgggtagtggaagaggccatcaaccatttggtagatttccgcaaacaggaaggaaccgccttggaaaagaaattcaacgaaaagattgacaacatcgagcgtttgttaaagtccatcgaaccctacgaaacagagcgtgtagccaagatacgtgaacgcattacagatgctttggaaaagaccatcagtgtggattatgataaaaaccgcctggagcaagaattgatttattacattgaaaaattagatattaacgaagagaaacaacgactgagcaatcacttgagatatttccgtgaaaccatggcaggcggtcatggacaaggaaaaaaacttggtttcatagcacaggaaatgggacgcgaaatcaatacgactggcagcaaatccaatcatgccgaaatgcaaaacatcgtagtgcagatgaaggacgaactggaacaaatcaaagaacaggtgttaaatgtaatgtaaccggttcacataccggacaccattctcataagcaaagaatcaagatatggcaacaggaaaacttatcattttttcagccccctcgggttcaggcaaatcaaccattatcaactatctgttgacacaaaacctgaacctgtctttctctatttctgccaccagccgccctcctcgcggaaaagaacggcatggtgtggaatatttcttcctatctcctgaggaattcagacaacgcattgccaataatgagtttctggaatacgaagaagtatacgaaaaccgtttctacggaaccttgaaagcacaagtggaaaaacaattggaagccggacaaaatgtgatttttgacgtagatgtggtaggcggatgtaatatcaaaaaatattatggcagccgcgcattgtctgttttcattcaaccacccagtgtagaagaactccgtaaacgcctgcaaggccgtggtactgatgcccccgaagtgattgaaagccgaatcgcaaaagcagaattcgaattggggttcgccgataaattcgataccgtgatagtaaatgacgatttggagaaggcaaaggcggaagcactgaaagttattagaaactttattgaacaataagacgatgatcaaagatccgaaaaaactggcccaaagaatgtcgatactttgtatcctcattggttttatagctttggctgtaggcatcattgcaatggcaatggagcaatacattattgccatagcaatgggtattgtcactgtaggacaagtatggaattacaataaatggaaaagagtaagataaagactggtattttcggcggctcattcaatcctatccacatgggccatctggcacttgccaattatttatgtgaatataatggactggatgaaatatggtttctcgtctctcctcacaatccattaaagcaacaaacggatttatgggatgataatctgcgattggaactggtaaaactggccattgcggattatcccaaattccgggcttccgacttcgaattccacctgcctcgtccttcctatactatacacacattggatgctttacacaaagcctatcccaaccgggaattcacccttatcattggggcggacaactggcttctattcccccgttggtacaaagcagaggagattttaaagaatcatcatgtaatgatctatccccgtccgaatttcactattgatccaacaacccttcctccttccgtgcaattagccgatactccgttattggaagtcagttctacttttatcagacaggcactggcggaaggacgagatatacgatatttcctgcatccggcagtatatgaacgactgaaaaaataaaaatccccgggaggatacaatccaaattccccggggaaaaacacatcaattatttaatctaaaattcaaaggacgcactccattaacgctttgccagcagtaccttactatttatcaatccgtccaactcccagcctgtcgtatcctttttatatgagtgccacgccaaaaacttcccagcttcatctaacgtatatacatatttctgcgtagggacaaacgcttttttatttttattccacaaagaataatcaatatgcgcttctgtgtctgtgtacgtaacttccatacaataataatttatccaatccgtgccattccatttcatacttttcttctctatgatttgtcccttatcgttgtatctgaactcaaaacgatactccggagtcaggaaagtaccttcctgttcataaacgaccttagccgacacccgaccattttccacctcttcatttgtaatcttcacaggcttggccgcattcaatgttaatacacttgtcattgcaaaaagaactgccatcatggctttagtgagcattgtagttttcataatgtcttatttttaatgtttataattcgtgtttatttgtgtctttatttataagacgcaaatgactctcaaaacgttgcaacatgatccgttttttttcttgagtcgcttcactttataaagtgcaaagtacatgccatggaattaatccactaagtatcaacaagtaaacataaaaaagggtgtccgattatggacaccctgtacattattaacggacaaacagtctattctttctgcttttcaacacgatgcaagactaccagaacaacttcgctgggagtaaataaacggacgtcaacgcgcgaagtacccaatccattggttataataatcggagtacctttgctattctctttccaaccagtcagaaaacggtttccataaatagagtgctttaccggagaatattttttaaacaagctcacctgcccaccatgagtatgccccgctaacaccaaattggcattcgacacatcggtatcttctgcataatcgggagtatgcgtgagcaatataataaaatcatccgccggaaaatgctgggatggagagtcaccattcttttttaaatcaaacggattgcgtacaccgctcactataatatactgaccatctttcatcagcttatagcttttatgttccatcaaccgcacatgattcttttgcatggcctccaccacttcggaataacaatagccataatcatgatttcccatcacagcaaatgttccgtaaggcgtataaactctgctcaaggcggtgaacaaagtatccagatttccacctttcttgccacgataatctccacccaacagcaagacatcggcatgcattgactttaatgcccgcaccgcgctgttcaattcactcctcttaaagcgactctcataatgaaaatccgaagcaaaccctatccgaaaaccgtcaaaagcgggtggaatatcataactataaaaatcatattgcttcacacgccctacccccggaaactcggacaaagtagctgtggcgcaagaagacaaaagaataaccgctaaaagcaaaaaaagaaactgtttcttcataatcctttctatttggagacaaagatacagaattaattgttttatctttgcacaaccttaattataaatagaaatggaaattgttcaagttaactcaataaaagcatggcttctagccgcccgccctaaaacattggcaggagccgccactccggttttactgggatgtgccttggcctatgcagacagctgcttccaaatgacaccagcattgctttgctttgccttcgcttttctgatgcagatagacgccaacttcattaatgattactttgattacctgaaaggcagtgaccgtgaagaccgtttgggtcctgaacgtgcctgcgcgcaaggatggatcacactgaacgccatgagaaagggaatcgccctgaccacagcaacagcttgtttagcagggttatgcctattagcttatggagggattgaaatgattccagtaggaattttatgtgttttattcgcttttctttatacagcaggaccttatccgctagcttatcacggatggggagacatacttgtcattgtctttttcggatttgtaccggtaggctgcacttactatgtgatgtgccgtgactggacttggaatgtgacactcgcctctctagcttgcggactgattatagataccttgttgatggtgaataattaccgtgaccgcgatcaggatgcaaaaagcggaaagaaaacaatcgtagtacgctggggagccaatgcagggcaacaattatacttatttttgggattggctgccgcatggctttgtttattgtttatcccgaccgggcacatttgggctgcattattaccccaaatttatctgttacctcacttcatggcatggcaaagaatggtaaaaatcaacaggggaaaagaattaaacagcatattgggagaaacctcccgcaatatgctgctattcggcgtattactagcattcggccttatcctataatcttccagcaagatcttgccagaagatatttcccaataaagcgcaacaaatcattccgctttctctatcaatacagtggcataagcggaaatgccctcctccctgcccgtaaatcccagtttctctgtagtggtagcctttacggaaacatcatccacatcaatcctcatcaaatgagcaagtaccaactgcatttccggaatccgcgctttcaatttaggacgttcagcacaaatcgttgcgtccacattacctactttatatccttttgcagcaatcaggtccaccgtttcagccaataaaatcttgctatcaatattcttgaattcacccgcagtatcaggaaaatgataacctatatcacgcatattggcagctcccagcaaagcgtcacaaatggcatgaatcaacacatcggcatccgagtgtcccaatagccccaattcatgttcaaattttattcctccaagccatagttcacgaccggttaccagttggtgcacatcgaatccaaatcctactcttattttcatcttacataaaaatctaataatttctcaccttccaaatacccctgcaaatgctgtcctatgccgactggccctactcccacaggagtccccgtatagagcaaatctccaatctttaatgtaaaaaaccgactaacgtatgcaattatctcatccaccttaaacaacatatccgcagtgttgcctctctgcactgtttttccatctatatccaaatgaaagtttaaattctgtatatccttaaatctgtctaccggcacaaaatcacctatggcagccgagctatcaaaccctttacacagctcccaaggcttgccttcctcccggaaccgccgctgaaggtcacgtgccgtaaaatctattcctaccgtcaccgcatcataataccgactggcaaaacgcggagcaatattctttcccaaacgattaatacgtactaccaattctgtctcataatccacctgctgagaaaaatcaggaataaaaaacggcttgctgtctttcagcagagccgaatccggtttcataaaaataaccggttcttccggtaatttttcatcagcatgtaactcgtggcaatgtgcaacgtagttcattcctacggctataatcttcatattattattcttgaattacatttaatctgttaaacattacagccagatgagcataaagtgatgtattctgcaccacaatattttccggtacacgaatacggaacggtgtaaagttccaaacagccttaatgccacccgctatcattttatctgttatctcctgtgctatattaataggcacagtcaataccccgatattcacatcacaggatttcatttttatctcaaattcatccgaatgataaataggaattccatttatttccttcccgaccaatccgggattaatatcaaacgcacctactatctctaatccaaaatgatgcagccccgagtcgcgcaataaagcacctcccaaactaccgacaccaaacaaaaaagctttatgcattttggtaaatcccaagaaacgctccagcacctctatcaacgcatcaatctcataccccacacgtgtacggccggatatatttacataagaaagatctttcgctatttgggaagcatctacattgatttgcttggatatttgggtagaagacacgtacgtttctccctgttctttcatcagtttcacattcgaaagataccacggaagtctgcgcaaagtcggctcaggcactttatccgagaatttatgcatacgtatatccatctttttctttaggtattatcattaggtaatttgcaaaagtacacttttatttgttacattgacggatagagtataaaaaaagtcttatctttgagtattcatttaagcaaaattcacatgaaaaataacgattggaaagaacgtctgaatgtggtttattccacaaatcctgatttcaagtatgaaagtgttgaagaggaagcggttgagacattagataaaaaacaacagaaactccgtgtcaatatagaaaaaaaaggacggggtggcaaaaccgtgacattaatcaacgggttcatcggaacagaaaatgacctgaaagagttgggtaaattattgaaaagcaaatgtggagtaggcggttcagtaaaagacggggagatccttatccaaggagagttcaagcaacgggtcatcgagttattgaaagctgaaggatatacccagaccaaataaccggaaaaaagaaagggactgttgtcacacagtcccccattctataattgcggaaatcttattcagcacgtaaagtgaaacgtttgaaagcaacgatctgcaattcaggatcagcttccttcaacacttctcttacagtcttcttaccatccatgatatcctcctggttcagcaagcaaacttccttcaagaacttacccagacgacctttagcaatgttttcaatcatctgttgcggcaagttggcagctttttcagcagaaacagtagcaatgatttccttagctttggcaatatcttcgtcagtaatccagcccttagccttgttactttccatgtgctcttcgctgtctacatgtgcagggttgataccagccttcttcaaagcaacttcaacagccttgtctacttgttctttcttagttttatcaatagctacctgtatttcagcttcttttacagattcaggaacaccggcttcatcaattgcaataggattcatagcggcaatctgcatagcaactccgtgagcggcagcttcagcttccttattcatggcaacaatagtacaaagctggttatttccctggtggttataaatagaagtataagcaccttcaaccacattgtagccatccaattccattttttcaccagtgataccgctacggtctgttactgcatcctgtacagtaccgttacccataggcaaagcctttacttcttccaaagtcttgcatctgttggcaacagcagcatccagaatagcttgagtcaacgctacgaaatcagcatttttagcaacgaagtcggtttcgcatttcaaagcgatgatagcagcaaattcgccatccttttttgccagcacacaaccttcagatgcttcacggtcagaacgttttgcagcaacagcctgtccttttttacggataatttccattgctttatcgatatcgccgtttgcttcagtcaaggcgttcttgcaatccatcataccagctccactaatcttacgaagcttggttatttcagccatagttacagccataatattcctttattttttaattgttagtaatatctttaaaacagaattgagaattgaaaattgagaattgagaatcaacagcataatctgccccttccccaattttcaattctcaactctcaatttatactattaagcttcttcgtcttctttcaagaaagcggcagccttagcagcattgatagcttcttcttcggctttatccatacgagccttggtatttttcttcttaccagcacccttaggagcattttcaccggcagcttccatatctactttttcagcttttctttcttccaagccttcagcgatagcgccacaacaagcatccaagatcacttctacagacttagtagcgtcatcgtttgcaggaatcacgaagtctacgtttgaaggatctgaatttgtatcaacgatagcaaatacagggatacccagacggttagcttcacgaactgcaatgttttctttcaacacatcgataacgaacagtgctgacggcaaacgagtcaaatcagcgatagagcctaagttcttctccaatttagcacgctgacgagagatttgcagaacttctctcttagaaaggtttgaataagtaccatcgttggtcaacttatcgatagtagccattttcttcacagccttacggatagtcgggaagttagtcaacataccacccggccaacgctcgattacataaggcatatttacagaagcagctttctcagctactacttgtttagcttgtttcttagtagcaacaaacaggactttcttacctgattttgcgatttgtttcagtgcatcagcagcttcatctactttagcaactgttttatggaggtcaatgatatggataccattgcgttccatgaaaatataaggagccattgagggattccactttctcttaaggtgtccgaagtggcaaccggcttccaataatgtatcgaaattagttctagacattttgttattctttaaatcgtttactttcttttttgtttatctcaaccaaccatcgggtagtccgctaccaagtagagtcccgctggtttagatactaaacgcttcttaaccagttccaagtaaaaccggatattaacgtttactgaactggaatctacgacgtgctttgggctgacccggtttcttacgttctacagaacgagaatcacgtgtcatgaagccttctgaacgaagagctgttttatcttcagggttgattttaaccagcgcacgggcgatagccagacgcaaagcctgtgactgacctgtaaaaccaccaccgtaaagatttactttgatatcatatttttcagcagcctccagcttgttcaaaggctgttttactacatactgaagaatagttgatggaaagtactgtgcaaggtctctcttgttaatagtaatctttcctgtaccttcgcttacgaacacgcgtgctacggcgcgtttacgtctgcctaatgcatttactacttccattctttattatttaagtgagtttatatcaattgatttcggagtctgagcttcatgtttatgttcactaccagcgtaaacatacaaattgcccagcaactgtgctcccagacgatttttaggaagcataccctttactactctcttcaacagtttttcttcaccgttaggtttcttcatcaactgggcaggagtcatttctctctgaccaccgggataacctgtatagcgcaagtaaaccttgtcgttccacttgtttccggtaaatttcactttgtctgcattaatgataataacattatcaccgcagtcagcatgaggggtaaagtctggtttgtactttcctctcaacagtttcgcaactttcgaaccgagacggcctacgacctgatcggttgcatcgacaacaacccattctttatgagctgtttctttgtttgcagaaatggtcttgtaacttaaagtatccactcttaaattcttttttaaatgttaactactaaaaaacaattcttcccagcgtttctaaccgttcccggacaaagaactattaacacgctaagaattaattctttataaacttttgataataatcggcttgcaaaggtacggcttttctttgaactgacaaacaaattaagatattttttcctcctgctttttgcatacaaaaggctgatacaaccacatctaggctttgaataacggagtaaaaacatagggaagaaattttgattcttccctatacatatacagttattcatatattttcaacgattccagccactctccatctcagagcaagtacaaacagccacagatgccgcattgtttccaccggactgacgaagctttaaaagttcagttgctgagatccgaactacttttccatcgggacgaccataacacagtgtcccttcgcgccgtgcagtttcctctatcaaccgctgttccgctaattctaaaccataacgcaacttcgcacttaattccttatattcttcttcagttgacataacttctgattttagtaaaaagttcttgattatagatatggacctcatctcccaaacggaaggcgtccgccacaataacacgcggtgtgcagctattgtccgcaagcatccaataatccacgcaaggcatataaatacggaaaaagttttccaaccccgaacgataacgacgacggataatgggagcaggtacatcatgccctccgttggcaacacgctgtttcactcgctctatagccagttcaggcgaattcagccaaaaataaataaggctgacactatatccttgattttgtgcctgctggataagattgatataagaacgggtagacaatgtagtttcaacagaaaaactgactccggctgacaacagttctccgatgcgtttcagcatcagtcgtcccgcttcgattgctacacttgaggggttaaaaggagaaagtcccttggcgatttcatcggcattgacaaattcacggcactctaaaatttcgggtaataccgtatacgaagcagtcgttttaccagctccgttacaccccgctattatataaagtttagacattaatctccttttctatttctgttattggcgacaaagttaacgattatttccaatttttgttctcgaaaaggcataaaagtgatgaagaatagcacattttttgaaattctgtgcaaattaagaagagattacaggaattttaccgtatatttaagcaacctgcaaacaggtaacagttactcactacatcattttattggaaacaattaatacatagacacctttcatttaagtatccaaacaagtaatcatataaacaagacacatatcccaccatatagatagggaccacgctttcaaaaaatgaaagagcagcccctccccaatgactatcctttgtttataaacaaagattcaaacttatctgaccaaatccttgggataaacaggaggcattttcacccgtttccaagtttcataataccaagaattgatttcatttccatccttatccgttttcacaaaaaacttcagtaccatgacatcgccccccttcatctcaaattccaaaatattatccacacctaccaattgtggaagatgcagatttttctccacatgctctgtataagcattaggagcagtctgccgataggtaccggaaccaataataatagctccatgattaggaatcatggtcatattggtaaacttgccgtcatcagacaaaattttaaaagaattacttggtttcaactcacccggcacctgaggagtacctgatacataaaagcacatctgccaaatccctttcaagttgacaggggctgcatctgatttttcctgtcccactacacgcgaagtaccgattagcaagaatgctatcatcagtaggaataattttttccgtttcatagctgtatatatttagttaacaaattgcgttatgtggatacaacaaaattagaaaaatttttcaaactttctgcttttcaaataacttttttacagttaaacacaaaaaaaatcctgctctatgttatagggcaggattttttgaattattatttcctacaattagaattcagcattgcgcggagtacgtgggaaaggtatcacatcacgaatattggtcataccggtaacaaacagcaacaaccgttcaaaaccaagtccaaaaccagaatgaggacatgaaccaaacttgcgggtatccagataccaccacatatccttcatcggaattcccagttcctgaatgcgggtcatcaatttgtcataatcagcctcacgttcagacccacctattatttcgccaatcttcgggaataatacatccattgcacgcaccgtctttccatcctcattctgcttcatatagaatgctttgatttctttcggatagtctgtcaggattacaggacgtttaaagtgctcttccaccaaataacgttcatgttcagaggctaagtctactccccaatataccgggaattcaaatttatgaccttttactacagcttcctccagtatcttgataccttccgtataaggcagacggacaaattcttccttcagcacgccctgcaaacgttctatcaatcctttatcgaacatatcgttcaagaacttcacatcatcatagcagttgtcaagcgcccactgtacacaatatttaataaagtcttcggccaaatccatattatcagtaatatcattgaacgcaacctcaggttcaatcatccaaaactcggccaagtgacgcggcgtattggagttctccgcacggaatgtaggtccaaatgtataaatagcccccaaagcagtagcagccaattcaccttccaactgtccggaaaccgtcaaactggcttgtttgccaaagaaatcatcatcataaataatcgctccgttttcatctttcttcaaatcataaagattcttggtagtaacctggaacatctgtcccgcaccttcacaatcggatgctgtgataataggtgtatgaaaatagaagaaaccacgttcatggaagaacttatggatagcgatagccatgttgtggcggatgcggaatacagctccaaatgtattggtacggggacgcaaatgagcgatctcacgaagaaactccatcgtatgacctttcttctgtaacggataagtattatcacaagtacctaatacttcgattccacgcgcttgaacttcggcagcctgaccagagccaatggattcggtcaactcaccgttcacactgatacatgcaccggtggtgatctgcttcaacatttcttcgtcaaagtttgccaaatcaacaacaatctgcacattatttattgtagaaccgtcattcagggcgataaaatttacctgtttgctaccgcggcgggtacgaacccaaccttttacattgaccatcgcaccaaaatcacggcgcttcagcaagtcaacaatctttgttctactaattttttccattgttttgtctctttattgtttattattcaaatgagcccatgcggagcatgttcacttcttgttccgtcaggtaacgccagtcaccgcgacgcaaaccttttttagtcaggccagcaaaataaacgcggtccagcttgattaccttatatcccaaggattcaaaaatacgacgcacaatacggttctttccggaatggatttcaataccgacttgtgatttgtctgtttccgatgcatagctgatggcatctgcatggatctctccatcatccaatgtcacacctgctgcaatctggtcaagatctgccttggttacattcttatcacaatatacatgataaatcttcttcttcaaatacttaggatgagtcagcttggaagccaaatcaccatcgttagttaacagtaatacaccggtagtattacgatccaaacgcccaactggataaatacgctccttacaagcacctttcacaaaatccattacagtcttacgttcctgaggatcatcagaagtagtcacacaatccttcggtttattcaacaaaatataagttttacgttcaatacttaccggttcgtcatggaacttcacttcgtcagtacgcttgatcttagtacctaattcggttaccacttcaccatttacactgactacacctgctgtaataaactcatcagcctcacgacgggaacatatacctgcattagccaagaacttgttcagacgaatcggctcatttggatcggtcaatatatctttatattcaatctgtttcttcagactatactttgcattcgggttataatcagccgtacgggggcgatagggacgattgtatccaccaccttgataaccaccggtacgaggacgataaggacggtcgccgccttgattataaccgccggtacgaggacgcggagtgtaagaacgctgttcaccaccttcaccgctgttaaaacggggacgcggagtatatggacgctgctcaccaccttcgcgattatatcctccggtgcggggacgcggagtataaggacgctgctcaccaccttcgcgattatagtttgtacggggacggtattgacgttcaccaccttcctcaccattattgaaacgagggcgcggagtatatggacgctgctcaccaccttcacgattataatttgtacgaggacggtatgaacgttgttctcctccatcctcactgttaggattaaagcggggacgttgcggacggtcaccattattattatagcgattataggaaggacggtcaccgttgttataagaagaacggtaaggacggtcgccaccttcgcgattatagctgttcgtacgaggacggtaaggacgctgttcgccgtcgttgttgtatctgttgtaattactgtctctgttataagacttataaccaccatcacggcttacattctggttttcttcgtttgcagcaccttcttgtctgctttcattttctgtactcatggttttccttttgtttattaattaatgtataacgccctctcgggcttttttgattaaaatccaactaactattttttaaatacctgtataattatgcggtgtaatcactcgcagttcctttttaatatcttcgcttacatttagtgtttctatgaattctttaatagccccttctgtgatagcttggtttgtacgggtcaaagctttcaatgcctcatacggatgaggataggcttcgcggcgcaaaatagtctggatagcttccgccaccacactccaacaattatccaagtcggcatagattgctttctcattcagcaacagtttacgcagacctttcaacgaactttggatagcaatcacaatgtgaccgaaaggtacaccgacgttacgcaacacagtagagtctgtcaagtcacgttgcaagcgggaaacaggcaacttagaagaaagatgctccagaatagcatttgccatccccaggttaccctctgcattttcgaagtcgatggggtttactttgtgcggcatagcgctggaaccgacttcgcccgctttaatcttctgtttgaagtactccatagagatgtactgccaaaagtcgcggttcatgtcaatcataatggtattgatgcgcttcatggcatcaaagatggctcccagattatcataattagaaatctgagtagtatattcctcacgttccaaccccagcttctctgccacgaactgatttccgaatgctttccagtcatattcgggataagctacatgatgtgcattgtaattacccgtcgcaccaccgaatttagccgtgacaggacaagctttcaatacagccagctgacgattcagacgataaacgaaaaccatgatttctttacccaggcgagtaggagaagcaggctgcccatgtgtttttgccaacatagggatatttgcccattcttcagcgtatgtagtcaactgagcaatcagctcttcaatttgcggatagtacacttgttccaatgcctcctttatagacaaaggtacagaagtattgtttatgtcctgtgatgtcaatccgaaatgaatgaattccttgtattcctccattccgcccaacttatcgaattcttctttgatgaaatattctacagcctttacatcgtggtttgttacactttctatctctttaatacgctgtgcatcagcttctgaaaaattcttataaatagcgcgcaatgcatcaaaacgtgcatgatcaaagcttttcagctgtggcaacggtagttcacacagagtgataaagtattcaatttctacctgcacacggtacttgatgagtgcaaattcagaaaaataagaggccaaagctcccgcttttcctctgtatcgaccgtcaataggtgatattgccgtgagtaaatcgagctccatattatattctttgataattatcagactgcaaaattaattctttttcttgagtttaacggcctgaagatgcataaagtttgcgaaaatgaagatttatttcacaaatccctttttagtccatttcagactgttccaacgctgtacaaagataataccacgaagattttcatccagcacaaacgcacaccacatacctaccaatccccatccccaatgaatgccgaacaagaaaccacaacctacggcaacactccactgaacaacaaatcctacataaaacggataatttacatcacccgttgcacgtaaagcattcgtcgcataaatattaatagcccgtcccacttccaaaatcacatcaataaacaggataatagtacccagacggataatttccggattatctgtcaaccagctaaacaaggtatgccccatcaaagcccagatacaggataaaaccaaagaaaccaaaatagaaatacgcatcacatatttgcctaacagataggctgcatgaattttcctttcacctaccagatgtccgatacagatggctccgccttgtgccatggcaatagcaaacaaataaacgaacatcactatattcaccacataggtacgggtagccagcgcttcattccccaacatattaataaaataggtcaatactacctgagagaaactgtaggacatattttctccggccgaggggactccgattttcaacaggtttttcagctcgacaaacgggaaggggcaaaaataggataacggaaatctgggaatatgcttgcggaaaagaattacaaaaagtatcaccatagatacccctcgggcaaatgctgtagagatagccgcaccttccactcccaaagccggcatgccgaacttaccgaaaatcagcgaatagttaccgatgatattcagaatattcacaactaccgttaccatcatgggataaaccgctttgttagcactacgcaaagaggcagaaatagtcagagatatggcttgaaaaaaagcgaatgcccctactatcttcatgtaactcactccatattccatcagttcgggacgaagtcccatcatagatagcagagaagtggctccgtaatgcagaatagcactgacaaacaggccgaacaccaaattgagtatcaatgatactcccaccacctgcaccatattcttgtgcattcttgctcccaaatattgcgaacagagtacggaagttcctatattaatcacctcgaatatcaggaaagcaaacatgatgagctggttgaccaccccgacggcagccacactattgtctgaatactgactcagcatcacggtatctaccgcgcccagcatcataatcagcaatgtttcaatgaaaataggaaccgccagtctggcaaggttctttcgtacacttctcggttcttgaattacgtccacttgttacccttgattttcggggtgcaaaggtacagacttttcacgatgtaacggtttgatttatatcaagaaatacgaacttaagatttttacaaggagataaacaggaatctgatcttttctttttatctttagaaccgaatcttaaatcaacatattaacatgaaaaaaggactcctcttgttatctgcaattcttgcattgggctccctgtcttcatccgcccaaagaagaacggctaccatgactgatgaagaaatgtaccttgatgccatgcatcgtaacatcactaccgaaaagattttcggttatgtaaagcaactttcagacccggccttggagggacgactcgcaggttcgcccggaatggctaaagctgtagatatcgtaaaaggatattttaaagagtggaaactaatacctcgtggtgagaatggttcctacatacagctattcccccacccttgtgtagagatacaaccgggaagcactatggatatcctatttcctgtcacccaagacaagaaaaaaactgtatggatctccaagacatacccttgggcagatggttggtttgccggaggaatgaccagtaacggagaagtgacagccgatgtggtatatgccggatttggcgttacagcacccgaattaggatatgatgattacaaagacatagatgtaaaaggcaagattgtgctggtagagggagaaacacccaatataagccgtaaccccgattcactggccatgtggtacaaacatactttgcaccaaaccaagctgaacaacgctgcagcccatggtgcggcaggcttgttatacaaatgggttcccggtccgaatgccccctataatccgggatttgtctattgtcatgttacagacactgtggtcaatgatattttcaggggaacaggcaagacctataaagaaaccatccggcagatttataagactcagaagcctgcctctttccataccggaaagagagcccacatcaaaatgaatgctacctataatcccaatgctactggaaaaaatattttgggcatgatcaaaggcagtgatcctatactatgcaatgaatatgtaatcatttccgcccatctggaccacttaggaatgattcctttcctaattgaaggagcgaatgacaacaattcttcctccgctgccatgctgggagtagccgaagcactggcaaaatcaaagataaaaccgaaacgcagcatcatctttatgagtgtggacggcgaggaggccggactcaccggaagtacctactacaccaaccattcccttgtgccccaaaacaaagtggtagcaatcctgaatctggaacaagtgggtgtaggtgagatgctaggagcgaattatcactataaataccccgaactggctgagctatcagagaaagccaatgataggtatgtacatcgacgtctgttcactagtgagactcatttcctgacccgccctcgcacagacggtgcagtctttatgaaagccggctatccatgtatagacttatgggccttgggaggcggttattaccatcatcccaaagataacacccaatctatcaatcccgatatcctccgagctgcaaccgaatggttatactggactacaatttttatagcagacaagtaaccggatataagaaatcccggcgagtcatcgctctgccgggatttctttatctaaccgatgttgtgtatgtgttgtcgtagatgtgcttggtgttgtgtcattgttgagtcagatattccttatacattttttctatctccttcatgggaatatccaatgtcttcacttgtctgaaaaactcaggcaggtcttcatgcaggaatgtatttttccgtaaagcaataatccggtctttagcccctgccgatacaaaataaccaatgccgcgtttattgtgaatgatctcttgtccctgaaggtaatcatacgtgcggaccaccgtatttgcattcacctccactgtggcggcgtattctctgaccgatggaatacgctcttcttccgtatattgtccttgcaggatttcatcacatatccggtcagctatctgcaagtaaatggatttactttctttaaatttcatagcaaacggaatttgggtttaataacttgtgaacgggtaaagagccggtaactcagccaccagttgaacatggtgaatgcactgaagaacgccacccctaaggaaagtaacttgtttaatgtcacccactggaaattagcttccagccattcggcgaaactacgcataccgtcattgcctacccatgatatgatatgtactgacaagaccgaacacagaatagaaataagcatcaatgtacccaatgtcttgaaaaaaggtttcttgtaccaataactcccccctagaatataaagtgaatgtgaccacaccaagaaagcccatccgcacagctcacccagccagttctggtaggacatattcaaagcggatcccgatcccctaaatacctgttctccatctatagcagccatagaaagaagatggtacaacactgattgatggaatgcctcgggcaaattaaacaaaggaagtacaagataacgcgtaatctctgccaatgaagcggcaactataatggctgcggccatccctaccgtaacaattaaaaatcgtgctacaaatttctctatcatagtcgccggaagcatcagaaaagcgatacgtttttcttttgtaatcatgttttccataatgttggcagcataagcaatactggcaataccaatgataaaaacaaaggtccccattatattagaacaataagtagtaaacgatatctgagaagacctaccagaactcattgtccacatatgaagtatcattaccaaggcgaatgcagcataaattcctatcaaacgataaagattcgttttccaattttccataatctcgcgtttcattaccattgcaatacgcgaaaagctaaagaagttattcgtatccataatgtttgtgtgtgttacttgttaaacatggtttgcattttttctctctctgccagcatagcgttgaataatacttccagattcaaattcgtttcctcattctcagtgttcgggaagatgacactgtttccctggacggacggctggacatagagtgctgtgtccgtcggttcattcatgccttgctctgcaaaatagactttgtcacagatggtctttaccgatgcattcaacaatacgcgggtaccgtcaataataaccacatgatccagcaggctgtcaatatctctcacctggtgcgtagagatgatgactgatttttcatcggtcatgcccgaagcgattactttacgaaactgacttttagaaggaatatccaatccgttgctgggctcgtccattaccaacaaagaggtattggtagctaatgcaaagcacataaatgctttcttcttctgtcccatcgaaagctcgcccaaatgaatatcttcattcatatcaaaatcacgaaggcaagtgctcaagagttcattgctgaaattcggataaaacggagtattcagcttcaagtattgtttcaaactgactgatggcaaagcaaattcttcaggcactagaaacatgtcctgcaaagtcaggggatagcgcatggaaacatccacccctttgtaaagcacccgtccggcctgaggacgaagcaaacctgtcattaaataaagcaaagtagatttacctgtaccgttcttccctaaaaggccgtaaactgaacctttgtccaatgctagcgagaagtcatcaaagactttctgttttctctttccataactgaaagacaagttctttacttcaatcatcattgtgtttatggttttattagttatttagtgtattagttgattagtacactgtaaatgtatatagtttatttgaataaacaagaagaatgactcatctttaatattcattaaccgttaaacgaattaagcgggcggcaaccaagtactgtccgctcaactcaaatgataaatgaaaaaaagaaggactatttaattcctcctagtgctttagtagcagtttcgtttccaggatcaatttccaatatcttattccaatacagttttgactggttataatcttcttttacaaaataataatatcccaaatagctgttacattccaccaacactgatttagtagcatcaggcttctgttccagaatactcagtgcagcctcataataaggctttgccaatccctgagttgtttcaggatcacgcaaagaattaacacgggcacgccagaagtttcctaaatagttatcgggaactttagcagccacttgtgcaaaaatagtatcggcttcagctagataaagtggttgcttatcctgataagcagaatcagtagccgcataatagttcaaacgtccatataaaaacaggtcactaatatccggatcacctttcattccgcccaaataatttttataagcctctatggccttcggaaaatcacgttccttttcgtatacatcagagatatctttatagatttccgtatgcgatttgtccatagccagtgctttgtcgaactgtgccaccgcttcatcatactgcttgtcagcttccagcaaacgggcgaaataaacgtaatccaaatatacataatccggattaccgggattagaaaagaaagtggcggctgcttccagtccttctttgtaatcctttaactccagattatcatacatcgccagacgtttcagcacatgattttccggagcaagttccagacctttctttaccatatccgaagactgcgcataatccttattcagatatagcaacatggcatagcgggtatagtcctgttcggtaggcgtacctactttcagataactttcataagcttcttttgctttgccatactgccccatcgtataatatacatcggccaattccttactgatacggttatcgtccggagccttagtctgcaaacgcatcaacatatccagtgacagttgagggtctacacctttatatacctgtgcatatttaaaataagcttcgctgcaattttcatccagataaatagcctggttataatcactgctggctttgttcacatcatttagtttcaatgccacatcaccactcagcagataggctacagcacatttactgttcacatctttagcgcgctgtgcatattcggcagcttctgctgtttttccctggtccagataagcccggcctatctctaccaacaaggaagtattcttcttatttttacctttcatcagttcatcaaaagcctcggaggcttttgccggattctcctttatcatcgtggcagcctgtttcacttggggtgaccattcgctgcctgctggtgtatgtccccacatagttacggccaggcacaggctcatcacggttaatactaattttttcatggttcttcttttttgttcatttattattcctcttttacatctacaatcctcacagcagccgtagcaggtaccagtcctgatttcaagatgatacgctgtccccggaaatctgtcaggaaagaagtcagaccactgggcagaccacttttaggatcattgagtaaaatgtacacattgcgagtgagcggatactggttcaaagccagataagcttgataaggcttgaaactatttcccactgtagccgaatccgcacggctgacagccattatccgaatgacgtcattgaaagagagtcgcgtactatccgcaggatttcctatccagttgacaccgataacccctaaagctgcgggattcttagccacatacgaaatcacctccggatttgttttctgcgccttcaggtccttcgacaaaggcataccgccgcagatcgaatcaagtacataatgtacggtgctcgaattgggattatcaaataccagttggagctcacccaaacgggaagcaggattcaactgtttccagtcagtaactttccccgtcagtatttctttaaactggtcaaccgtaattaatgaatccgtattttgcttgttcactatcaaggccaaaccatctgtcgccatctttaccgatacaggaaagaatttcttgtcattaagataggctgtttcctgcctggtgagttgccgggtggttatagccagacgtacactatccgccagcaaaagtttcatggcttccacttcgctgcaataaatgggatgcacggtggcatccggtgtcaatgcataaaacacctgtaactcctcttctataatgggacggaaagtttcgtccaccgctatcgttatagtgccagaggtcaacgtatcgtcttcccccggtttgggtttgttgccgcagcccgaaagcagcagcaacgaagcagccaataatgcaatatacagcttcatcatcatatatagatattattgtagcttaaaagttataggaacggtatagtacacgggaacattacgtccgttctgtcttcccggaatccacttcggcaatgactggatcaccctgatggcttccttgtcgcaatacgggtccagagaacgcatcaccttcacatcctttacgtcacctgtagccgaaaccacaaagcggacaaacactttaccctgtattcctttttcctgcgcaatggtaggataatgcaaattctttgctataaaagacagcaattctctatcaccacccgggaactgaggcatctgttctaccatagtatatgttttttcttctgcttcgggggctttggttatcacttctttcagttcagcaatatctttaccgttcaactcatcattacctttcacatcggcaatagagatagccactttggtctgagtcaattcttcctgactctttatctcttcatcatcacgcacttcttcatcttttttgatgacaggagctgtaaatttgatagagcttttcagagcaggaggcggagccaccggttccactttcttgaactcttcctgtttcacttcgggttcttccagttgtgacaaggtagtcacctctgtcatcacctctttctgcttcggggttgccagttttaccaatgtcggtatactgaaacctatggcagcaatgatcactacaattaccattgcccacgtgtggcgtttaggtgaattggcacgcatcttataggcaccgtatgccttgttcttaccttggaatatcagttcacaccattcaggtgaggtcaaatctatttttgccattttcttttcctccttttaaatgtgtgttactattccgcaatgtctttactcagatcgcccttcgtatcatagttcttgatcaagaactgatctgcatctgcgatgtctgtaattacatacttacctatattgcatatttgcatttcatctagagcatcaatcagattcttgtatgaagagtcatccgttgctttaataataacagtcggggtatcctttccgctttttatttcagccagttttttcgtatactcctcctctgatatctttagatcagctttctgttttttcagatcgtttacttcacgaactgccgccgagttctttttaagaagaatggaacgcagaccatctgcattataggaagtttccttcagcgatgtatagtctttataattaggttctccttcataataatacaatttatctcctccggccagtaacagggtaattgcttgtgaagccttcaccttgctctgcttgctcttcagtgatgttcttgtcattgctcggcatacttatttccatcgtctgaggtttgctcagcgtggtacacagcataaagaaagtaatcagcaacatgttcatatccaccataggcgtaaagtctacgcggacagtcatctttttttgcttcgaaccctttccttttttgctgctttcttgtacttcagcactcataattattcggttttatttatcagaagtagtcttcagagaagtaatcagattgtaccggttctctctgaggtcctgaagtgagttcattacgtttttaatcacagcgtagggagttgacgcatcagctttgatagcaatacgtaaatcaggattcacctgacgagcactgcgtacccatgatttaaactgattatctgtactgtcacaggggataccttcatttttcaacagtttatcctgctggtcggaaggcagatccagatatttctgcatgcttctcatcgggacaccaaatgtagaagctgtcacaaatttcttctcctgctcaggagtaaaatcaactccgtactcctcacccattttctccaatacggccttcatgtcgggctgtttgtcgaggctcataaatattttcccttgcgggtccaccagaatctgaaggatattcgtttccggaatcttgatttcagaaacggaggctggagtaaacacctgtaccggctccttctttacgaatgttgaagtcaacataaagaaagtaagcagcaacacagtgacgtcactcatggccgtcatatctatgaacgtacttttctttttaatctttgctctacccatagcagtttattttaaagggttggcacgattatttatgagaagccgcaaaggtctgtacaatagagaaacctacttcatcgaggctgtaagtcaatttatcaatcttattagtgtagtagttataagaaataaccgccaatgcacctgtcaagataccgaatgccgtattgatcaacgcctcggaaataccttgtgacaaagccatggagtccgtaccaccaccggcagacaaagctgcaaatgaacggatcataccaattaccgtaccgagtagtcccatcaaggtacccaatgtggtgattgtaccgataacaggcagattctgctccatcatagggagctccagtgcagttgcttcttccaattctttttgaatggccagtactttctggtccttggaaagtgtcgcatcgttttccacgtcggcatactttcttaaagtcgaagtaactacattggctacagaaccgccttgtttatcacatagctcttgtgccttcttcatatcaccagcggccagggtagatttaatattagcgacgaatttcaccagcgaacctctgccaaaagcagaccggatggctaaataacgctcaacgctcaacgctatgacggtgagcaacagggtctggataatgggcaccactacaccacctttgtaaattgttcccaggaaactgcccggcaacggatggttattagggtcattattcataaagttagatggattccccaatatgaagtgatagatacaaactgcaatgataaagcagcatataattacccaacccgcatttttaatacctacaatcttattagtagttttattttgaatagtttccatgatatatgttttaattaatcgttatagttaaatgacaattctataccaaccccgacactctgcagggcgccggagaaggtgaaacaactaaatttataacgattaattaaatcaaaatgcgtctcagcgtgaacacgaaataatgacatgccggagacacacaatgaatgggattagacggaaagatcttagcgcggtcagttgccagtatttcttcccgtagtgaaaaacgacctatgagaatttttaagaagttctgttgaagttcctctgctctgcggatacggagatcgtcgggcattagtttcgctaatacctgctgttgccctgtgagtaaagagtgggtgaaagacatggtatccaatgtaccatgatcagatgccatattatcttgatgttctgtagtagtagcatatctgtcaatagcggaagaaacaacatctgcatcgactccctgataattaaacattaaaagcaggactattaatcctattttgacgataagcttcattttggctactagtttcgaaagattctcggtttatattattgaaacaattctattgtttttttgttcacgcagacctaaaaattattcaagttcaagtggtaaatatattcgataatcataaagaaattatgaaatacaatctttttaaccccttttctaattctaaataaaaacctgccccttccggacagttccgtgggaaaggtacccacacccacggggaaaaaacggtagaggccacatttcacacgtgcggatacaaaaaaaagcctccggaacttcttcaagtccggaagcttcaatcaaaacggcggctaatatccacattgaccaacacgctgatctttccccgcctgaaatcctctaccagtcttccacgttccaaagcgggagtcttgctgtcaatagcaacagactccacaccatgtaagctgtaataggctgcaatctgtcgggcgtgtgcaatacttacggcatagacaattcctttcttcccggcagcatatcttcggacactctcgtacaattggcggataccggtctcccggttcagcaccgcattcatttccttcacctgataatccccgtccgcaccccgcttcttcaacgagtcaaccagccgctgttccctgctgttcgcacggatggacacatagtcaaaggacgataaccagcccctcccgataaattccgcaatgctccatgaggtaatcagggtatcaaacaaatccgtgaatcccttgcggttcagccggcagggggtagcggtcatacccaatttcctcgcctccggataacttttccaaagctcccgataagtttctgccagggcatgatgcgcctcgtcaatgacgatcaaatccggctgtccgtccataatcttccggtttcgtgacaaccactggatagacatcaccctcacacttccgtcctccctccccattccataacgggaaaccgtctcctctatctgctccaccagttcccgacgatgcgccacaatccatacccggctaccggaaccacacaagaactccctcactatggcagccagcaggtgtgtctttcccgtgcctgtaggcatctgtaccatcacactccggtgaagctcccactcttcaaagagcctgagcttcatctcctgctggtagtcacgaagacaatcgttcttgcaatacattatacggatgccagtcgctaccgacaacaaaaacaaggaaggccgcatacgttatcgcatacagcctatagtaaatattctatctttataaatttattttatcggcggttatgaactgttcctccaccgaattcagacaggacctattattgtctatccctctataatccaatcactcaaagtgtgactttccgagtcaaagtttatccccaccttcactacgggaagtccgcaaaacggaaaagaataaaggtaacgaacggtaaccgtcatattataagtatccaacccctatggcaatagtccttatctcctgtattcactggggtttgggatgtatcgtaagattgaattgtaaatatttgattttagccactgaaaagtgcctaaaaaacatttgagctaataatttaagcgatttctcaacgattggcccatgccaatccgatattatggagaagggtaagattaacaaaatgaaacatactattccaccaacgataataaacttttcatctttttgattaaaagttcagttcggttaaaaagaggttttacatcttcttcagcccaatcgaacatgtcatcataatcaccggcatgacgcatattctgtaaacgagagaccaaacgcatctcatctttgtccaacaaccctttagttgcaaattcctgccccaacaaacaaattacaccgttatgggtcttagatctaaaacctttatctatcaataatgcggaagccatgtggaagacagcataatacaaacgatttgcaaccacattccaatgattcatggtagcattgtccgaagcttcaataaaaacgctatcagccttttgaacacggtaagcaataatagatttcttttcttctatacttagtggcataattcaattccctcctgttctacattcttataaaaaagagtgaaactccgtctttgccaatctgtataagtatatatcaatggattgatatccgcaccgattttccaacctaattcaaccagtggataagctacacggtcaaaatcttcattatatatgcgagatttgtccaataaaataagaatatcccaatcggactcatgatgtgcatccccacgagcctgagaaccgaataaaatgacacgactccctgaaggcatcacctgacgaaccgtttcacgaatggaatggataatctcatttttttgcataatggtattagcttaatatattgtatgacaaagaaacaaattatattccgcttatccaataatgaagcaattatattttagtttttttatgttatagtccaattttgacgtgtaccccaaggaaagccgccacaaggcagttctccaataattaacgtcaaaaaagatactgatttttaatatttgttattgctccagtccgattgtcaagggtaacaaatattcataatccctacgtcctttaacaatttcactgaaaaatctcttgaaataatcaagcacagacacaccctgcatcctgcaagtggagatgatggtatgatataccgctgagacgccggccatcttgtcacttccgaagaataacgagtgcttacgctcaccaaccaatggacgaataaaacgttcggcacaaactctattgtcggcactcatagtacggcaaaatactttcagcaccattataggttacctgcataaactggtatccgggtctaaaacgtctctcaaacatactgtaagaccgtcggtcatagctgaacaaacgaaccagacgtaaacctttagacatcacgataaagacatcaccatcttccggctcacggttcaactgctgatggatgatggataagaccttatcatatttacagcgcatatcatgaaaatcacgaacaaagaaaaaacggtttagtcctgtaatattcaacataagacctccagtttctccaccaagcttttcaaaccttcgtagcttaaatttttctgactaatatgaacaccattgctcatgcggatatccaccaggattcgaagttcggcaggcgaagaaagccgaggagccgattctggcttttgttccgggattagcgaaggactttccggcatttctgattccgtggagggagcacccaaaacctgaacaggaactatcttcctccggatatccttataccatttggaaaataggttataaggaacttggctggacatacaaaatttctcaatagaaacacccgcagggataccttccaatttatagcgcaaaaatagacgctcaaaatcattgtaactatacataaacttggcttttgatttaacgaaagcaaagatctaacttttatatcggttatcctatacgtcatttttggatgctaacgaaccatttctgaaagatgttataaggaaccttgtgcttaacacaaaacgattggagagattctccatgaggcaaggcctccgtctggtactgaaagtaaaacctttcaagatcttcactgctatacataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctccgtctggtactgaaagtaaaacctttcaagatcttcactgctatacataattctataaatttggttggcagcgaagataggactttcaattaatagccatttttgactgcttacataaaataggattggcaatatgccaacagttaacaagcaagttatttttttaaccattctgtgtataggcacttgaaaaagtgtttaggcaaaaggagatgccctaaattgagtgcttactaaaaaaacaatcaaagcatttgatatagaaaataactagcgttctcataatcaaacatctcaatattttgattatcgaccttacctgtaaaatagcattgagattcataatcaaatccttgaaattttgatttattccattctatagtaacatgataattggctacataatcaaaaagcatgtcaaaagctccttttacatgtccgtttctctgataatcaaatacatgaattccagaaatagaacgatgcataaccaagaaatgaaaatattcaccctttgaataatcaaagaccatttgttttttacgataaggattcactttcattccacaaatgaaagcgatacatgcccttttatcgtttgtcatctttataaaatttatagatgttactattgctatgcaaattcagaatcttctccattttacgggaagccgaacaattacatgtctctaaatgcatataggccaatgcatattcattatatatatttgtcatgaaaatccccgggtcatcactacctaacacgacagacggaagcaatattttttcttggtcaacctcaagccatttttccaaatgatattcttttaaatgttgatagtgactgatacataaattgcttgtaggcaaagcttcaataacaatttccttcctagcaagatattccaaaattagcaattgtataattcccaatgcatcagaactaaataatttatccgtttctatttctatcacttcatcataattcttccggctgtttacagtatcccccaagtacttccgtccatttgtcgatgcatgataagcttctataattggtttgatcccagacttgccaaactcagtttgtatatcattatactgttcgtatgaataattggaataccagctatcataacgcatatccgccttttccaaaagaagaaacggatcatattgcctatattcccaagctttgctcaacagatagggcagataatacgtcccatataccttataagaatattccgcaatctcactctcaagaggcagaaccagatgttgcaacccttcatgttttgattcacgtatcagtttccatacaaataccaaatcatccaaccactctccttgtggcaaataacatattttcccaattctccgtatccacaaatcaggtgatatgcctatcgccgtacaatgtcctaaacggtcgcccggccacaagtctaaaaaaatcacggcttctacaatagttctcagtccactcactaagtggctaaaatcctctcctgcatgaaaagtgaaatgtttcactccctggtttcttaaaaaacgatacgtttgtgcaaagacctccggtcctgcatcaaattcactagcagccgcatcgactcccactacatattgtttgttatcaggactttctttcaaaaaaacggccaaagcgatggcttttcttttcagttcctttcgcaggaaacgggatctgatattaaacttcttctcgaacgttttttccggacgctttatgaaatgcgcaatcaatcgcaaatccgtatccttcaaaaattccgattttcttttagcctcttcgaaacctcttcgtattctgctaaccagcaaactgttttctacggatgagttctttggagaaaaacggccttcgattaaagctagctttgtacaaaagttacatcctgccagctgtaaaaaacgtttttcataaaactcttcaatatgccacctaaatgaattttctgtcaagagctggaattgcgggaatcccacttgaagccgttgcatcaccacaaaccgatgaaccatgccttttatcaacaagtaatgatggaacatacccgccactttggtatcatgataattccttatttcactcatgacacacaggcagaacagcaattcatctatcatcatcccagtttcactcatccccccgaaatccccccacaaatttctcaatctaaccggagatgaataatctttctccccttttatgatctcctccttaattaagccattactaatagctatttgtgttatcaatctgccgcgcaagtccgccgcctgcttcatccgttcatacaatctgagaggtgtaaaatccgagattatctgttccgacaatttcctgactgccgctttactttcatacgcatcctgataatctttcgccatcttataaggactcctcaacaataaattccataacacatccgtctctgttgttccgttcaaatgaagatgcaagtcattcagtcctccttccttctccattatatagttaaatgccggtatgtatggaagtaactggaccgtatgtttgaactgcttcaagaaacagttggcaaactccatcattttcctcctgtccttttgtaatgccgatgtaaacttatccgcaaagaaagcggaaatcagtaacaaagggggaaactgctttatcagttccatccattctgtaaaacgatcagcctttacatatagttcgtgatttaccgatatcaaatattctttggcaaggtcataaggaatccctcctatcaagtccggcaaatcccggtaagccgctaatgcattctttgccaatccttcataataagaatcatgctttagaggagcgttttgtctttccagtgcaatcaaccttcgttgaacctgtcctatggacacctgtctacttgttccccaataacgttcatactcaaacaagctttcgttatcacacaatagttgagataatatcggaatcatctttatcagatatagattgcattcagaatagcaaagacaggagaatcagactgatgcagtgattcataattcgcttttacaaaatcagctacattttttatttttcctttcaacaagtttatttcattgaacagttccctaagaccaagttttgtctcgctcattttatttgatatatcatcttttatgaaatccacctgcatttcatccatgccattatgtagcaagacttctaattcatccacctttattatattttttgtctttttacgaagagtctgtttctctttcagcaattgctggtattcttcttcctccccaggtaacaaaaattcagacgtattgtatgttgacaatttttcttccacttccttcaattggataaaatactttatccactcttgaattccattataccttttcaattcccacaacacattctcctgcttttttagcaataaagccagtttattattcatctgatcatattttaacaattcattcaagtactgttctttctcctcaatatcattttgcatcaagtattttaaaaagggattcaaaaaaatctctagcagaggacattctgaaagccatttataaaaatcagttttaccgtttatcgtcattttagaagatgccgcctttctgttatgaatatagatggtctcaatatcccctattacattaaagttcatattgggaattccgtattcggccatttcttccaccaatgcagcattcagcagagccacaatatacgcattaaatttcataccggcacttctatatttatcatcctcgtctatctgtaacatcgtattatagaaccggataaaaatatgatagagtaatgatgtcgaaacctccacgctcatatctgctgcccactccttcaattctctaataacagtagtccacaaatcgtcctcctttatatctatggtgacatcgttccaattggccaatccttctttccggctcaccggatccaagaagaagggttgcaggaaattactatatggagcttctttggataacatttcttctaaactgtccgaaccgttgttcttactgtaaaacaaggtttctctgataatcgccagcaacctgtaaacagaaagaaaaacattctcatgttgccgagtatctattgtacccaacataggaagcatggaaagcacctgattgctttccgacagcaagacaggagcattgttgcctataaatatagttcccgccatggtttcaacattctcctgtttgttcctattcaacttgctgttacaaaaggcctgtgccaaccctacactcttcagtaaattgatattagcattcaattgtgaaaattcaagtaagtcacgtaccatactccgatccgacagctttcctcccaacctttcgcttaaaacctctatatacgacaaacgtatccaataatcaaaaatcaggaaacgattttttcgtaccaattgattgaatttagttccgacagcaaaaagagccttgttcaatatatcatcattggtttccggaaggaagttactgcctgtatacaatgcattagcatgtatcaggaacttcagcatttcaatagtatacacaggtgtcccgttaatcaacaatttagtatttgccgccttttgattgatgtcatttgcaaaaacattcagcagtcctgtagttatatccattttctccttttgggcagaattgaagttcaataaagtcaggatacgtacctgtcccctcaaagataatcctaacaggaaatggcatatttcagtattaatcctttcatttcccgatgatatcccgatacggttcaacaaatccttataacatttgacaatagcctttccctttttcgtatccgtatagattacttccaaagaataatcatcctcttccagatactctctgattgtttttaaatgtattcggtattccggtttcaaaagtttaatcagatattgattttccaattggtctatcatttccgcaaattcctcttttctatgtccggcatactccatttcctttttcaagaagtcatcatcaaaacatttccagttggcttttcttaccagtttgctataaagttccaggtctccggtcagtatggttattatctgcccggaagtaatgtactttctcaacacttccaatatttcaaatcctttcttaaaatccgtatcaatatcatcaaaaggaatcacaatacattttttatccagcaacttcaacgtttctctgatatagatgtggaatctctcttccaaattattaaaagccttggctttattcataccctgtatagaaatgaattcttcatcatcccatccgtcatatacattatctttacctatgccatcaataaaaggcaatgcctttagcaagtcattataacaatcagcatgttttttctgttcttcaaagcgcttgtctctgacggaataataattttcgttcaaagcgttttccacacattcctgaatagcggccaatatattgataaacggatgttgcttcgtttcaatcaatgaaggatctataggacttaagcataatatatcctttcccttgtctctttttattctgtctagaaaagacaataagaaagtcgttttccctgccccacgactggcaaaaacagaaatagtactatgaaatctatgaaaatcagtattttccccaacttctatggcattgtcatacaactgatcccacattcgcataatctgtctcattttggaacggtgtatcaggctctgttcgtcatagggtgcagcgtccgaataatcacacttggaaaaatctaaaactactttattctccatcttacaaaaattacggttaacagcaatagctataatagcttaatatcacttctcttatttgggttctggcatatcgtctggcttctatagcagacaaccataccgatgataacaatacagcgaaaatgacaatgaactcgagccatgatatatccttgttcagtccccattttaaatctatcaatacacctatagctactataaaagaaaaaatcaatccttcaaaaacagcctgcattacccacattctgttcataaagataatctgttctttggcttcttcttttttatgtaattcaatccacatgtaactataggctagttttttatccgaaactgataaagataaagcattagaagccaaagcattcattgttctgtcgtaggtttcttcaaaatctttatctgtattttgaactatttttcgaatcagtctcccgattatccaagaagaaagtccgcaaatgtatgccagaaatattccgcaaacaatagttatggatatgtttcgtataaagaactcatagtaatgataatgaaggtcaaacagaacgatacccaatgtaaaaccaccggaaacaatataggaaaaatccaatatgctgaacgcattggacagtatgtctataatcttctgaaaactaggcatagaaataaatattaattaagttatttcagatggattttgaaataaatgccgccggagaagtatttcccgttgttcagttcggcaataagattgatgtggtctttccagagttgataatgtgcgccgatgtttattgtgcgggcgtcgtattcggccatcaggtccagcccgttcaaagctttcaccgccaggttgtcttccggcaaaaggttgaatttgaaattcacacctgcggcaggctttctgtaatgagggaaccagcaggcacggtaatccacgtatgcggcgtgaacgcccagtgttcctatcccggcaaaactgaaatgcttggttgccgccagataatatcgtgtaaaatgattgttctgcataccgtcctcatcgaacttgatggccccaccaccgtatgcttcatgcgaggtgggatcgtccagacccaggactatctgtggagtccagggcttccaccagccttctttccacaaccgcaggcgagcattgaaggcgcggtcctgattggtgtactttccccaagactgctccgggaaataagtggagccatgctccgcataattgatggtgcaggtgtatcccacttcgagccaggggaagatggttatgttcagataataattgaatgtgtattttatctcattactactgatatattgcaacggaacaagatgcaacacattccctcccgccataaatgtcttgtctctttgcatctcggcagtgggagcatgaagaagtcccgttgtaccgtatagtgcctgtgcctgactctgtaacgagctaatcgcaataaggcatactaaaattaattgtatttttctacccatcatccctcttcatctcttccttaatcagtctgggcaaggtctttatgaaattccaatatcgaggaacatttttcttcgggtcttcaaaagcacgatgcaaccactccagtttaagtttcaacatccagttcggagcacgccttacatttcccactccagcattgaaattgaatatggctccaaagccaaacatcactccacgatgtaaataaggctgcaaacggttcatgaacatttcctgtttcggagcgcccaaagatacccaaataatatccggtccatcctcatttatcatttgcgcgataccttgataatcgaattcatccactttccggaaaggcaaggtttcaaaacgcatattctttatttcaggatctatttttgaaagattatctttcagtccggaaagcacttcctgagtattacccaaaaaaaactggcgatattggcacatccgcacatattttataaaaatatcagctcctatatatgactctaaaggctcgtgatgaatatatcccaatattttggcaagtacggatccgtcacaattattgactaaggccccattcaacacgttcaaaaactcagaattattattggcaacagtcaaattattactctcaaccgaacagacatatcctaccgttccctcctttatagcattttctatggtttgctctaattttctcttatcaaattctaaacggacattaaaatatctcttctctttcataaaaccactcctatagtcataaatttcatcaccgaacaggcttgcaggctatgcctgtaacctgccggaatcaacagatacgtcccagccttacagatatacttttcatcaactatcatcataagcccttctccttccataaaataatagtgctcatccatggtaggatgcacatgagtatccacaaaatcacctttatgtaattctgtaatcgctatttgagtaagagaagaagaagtttcctgtgaagaaagaagaacggttttcaaaccgacatgatgggaagtagaaacgggaagaatatctgaaaaatccttttgaattattgatggcatccgcttttttcaatttgggatttcacccattcatattgctgcctcaaaccatcctccaaggctattttaggctcccaacctaatattgtttttgctttggtatagtctgcgctacgtgccttgtctccttccggcttggtcgtatcatagactatttcaatatccttaccggatatttttacgactgtctcggctatctctttaatggaagtacatacggaaggacctatctgaatataaccatgcccccatcccttttccaaagccagacaaagagcctcgaccacatcgtccacatgaatgaaagcacgtccttgcaaaccactgccccatacattgaacggctcttcgggataatttacagctttacggatcaaagcaggaatcacctggcttctttctccataatcacaaggaggaccatatacattatgaaacatcaaagtacagcagggaatccctatctccttttctaaaaatccaagttcaatctgtcccatcaatttactccagccataagccgattcaggaaaagccggaaaaagttcctcttcttttaaaggaaccacatccaaagaattttggcgtgtcaaaggaaaactgcaagccgttcctacgtatatcaatcctttcacacggtctttccccgcttttcgtacagaattgaatacatgggtattaattagattattcaacctgaacaattcaccttgatttccaaaaacataatcaattccagcaacgatatcggccaaatgaatgacgtaatccatattgaacacaatacggtcacattcattccctacagatagatcgatgttaaagaaatgagtatccaaatcaatgacaggcttgcccgcttcatcattcaaatactctaattttccacgccacaaattatctattacataaacatcattaccttcttttacaaggcgttttaccaggttggagcctatcatgccacaaccaccggtcactaatatttttttccccataattaatttgtatattgtttgataattcccaatttcatcaaatacgtttttaactttcctaaaacacgtgctttcactgaataataagaataaaactgcctagcaatacatttattttccattagcataaaggaaaagttaaattgctcttttccagacatatcaaaatccacacgatatcgattataaacacaacaatgcgtagcttcagaagtaaatccatcatttattacttttgattgacatggatataccgtcaacttattttgtttaaattgattataactaaatcttatccaccacgaacttatacgcccttccatacaagcgaataaaagccctgacatttcactacctagttgatcaaattctttttgattttttttattaaatctaaactcattccaatctgcaatattccaatctactgtttcccaacgatctgaccacgtaccccatccccaacaatgagcttttcgagccataaatgaatcataggggtaatcccaacatttaatttggggagaaaagccagacactgagaaaatattattttcaaattgaaatttaaccaaggcttgattcatccaatctaaaaagtttgacgatacgattaaatcatcttccaccactataactttgccatattttttaattattaaagttacaccttcaataatagaagaagctaatcctttatttacagaagaataattacgctcaatttttctaaaccctgttatagtatccagatagttcctaactgtatttattataatcaaatccttctcatttttcggtccatccgaaaaaatatataaatcagtttctcttgacaatctatttttttttaaagagtttatagttctctgtaaacagtctaatcggttatacacaaataatactattggagctaacataatatacaattttaataattagaatttaaaagcactacagatatataccttatgaataaatagcataagcataaaattcacaaattgaaatatgacgagataggtgcaattatagaataatttactttttcatatacccaagtaccatgagatatgtagtaagtaaaaaatagaattaacaatatagacatcactcccatttgtacattcgacacccttatcatcttgaagaaaaatgtgcttgaaaatggtaaaagaaaccaaataaaaaaattaaatcgaacagagagttccaattggtgtaaattcaatattataaaaagaaataagaaaatgaatatgtgaacaaacaagtatcctccagaaggtttactacttaacttatcataaaagtaataatagtaaaatggaataaacactatacaaaatgaaactattaattgcaacatagataaagaagataactcaaacgttgtgttttgggaggttcttttcaaaatatatccaacaataggtatattttcaaaaactacatataaataagaagataagacttgatacaaagacaaaagacaaaaacataagataacacaatacagtcgttttcctaccaatctatcttttaaaatcggtagaaataaaaagacaacaaaaaaaagcgtagtagtatgaatcaaaaccatggcaataactaaccaccattttttgttgttataaaagcttgtatccactaataaatagaacaataaagaagtagccagtatctgtctcactaaatgggctgacattataaataaatagggagtaaacatcattatgcatatacaaaatattataaccttataagacagttccaacttaaaggccaatttaattaatgaatatgctaaaagtccataagagataaaactgatacaaaaaatatagacctttgtgttacttccgataatccaatacaatatataattaagaactgaaaataacggttcttttatagcctctccttgcgataaaaatgttatataagtaaagaagtcagtatagttaacagccttatagtagtctaaatacatttccaaatcattgtctggaacttttgttgcatttatacaagaaatataagcagcaaatataaaagaagataaatacaaaaaacttcgatgggtaattctggaagtaataaaatacagaaataccaagaaagtaatagccactggatttaaacaaaacaatattaatcccactaatacaattcctttagtagatagacaaattctattacccatataaaaactcactttttaaatagattcttatattgattatacaccttatctggaaacacaacaataattatttctaatagcactttatatatggcatagataatattgaaattctttttgtaaaaatagaatgctgtttttaaactcaaactcattggagtatttaaatagcgcaatctctcccttatgcctacaccggattttctaattctatttgttccgttttcattccgagcacaaataccaacatattgtgaagcaacaaaaactttaaggcctgcatgccttgcaaccagtccatagtcataatcacctaaatgatgccaataatggctatctaagatgcctatttttttatatacactatacgggactaatacaaaatttccattcatgtaaaacaattcctgtaaagtcccgttaggaaaaatcggacagccgtctttagttttacctccataagaaaatgttccattctctgtattttggaaacttccacaaattatagaatgatttcctgcaagtaaactatctccgatcacgacattcaatgcatcattatacaaaatagtatcatcattcaaccaaataaagtagtcgtaatagtcttgctttattgcagctttccaagcctctctcataccccgattccaaaacaagttgccactaccttgaataagaaaaactttattataaaataaactaacgctttcagatgtattatcagtagacccatcatcaactaaaaacacatcaatactaaaatgatatgaattatccaaacagtatagagaatgcaaacatctcaatgttttctcacagcgattatgacaagtcatcaaaacagcaattttcatgatgcgtaatttaaagccttcctccaattttaacatatcccatacagactcagcagccgttaagcggtcttcgtatctttattactttgcatggatttcctcctgcaatacagtctgcaggaagggattttgtaatcacactgtcggtaccaacaattgtacggcaaccaatggtcaccccttttaagatgattgtacctgctcctatgaaacagtcgtcaccaatcattaccggagcactattacggtgttgacgatcagctttcttgcagtcacggcgatccatataatttaaagaatggaagtcggaagaatagattttctcccctcccactagcaatggtaagtgctcaatttagggcatccccctttgaaagggcacattactatgccctacactgaattttgttaattaatcagctttgaatttaacattggcttgtagccaaagtgattttgtcaggaactatattaacataatccctgcatccattaaaaatcttttaaaaaaatgctgaatcctttaacagttcactttccaacaggctgcgtaattccatcaggagttccttcgtttccatgctttgcctttcacgcaacctttcttgcggagtaagcccggattcatcatagatatgttcgcgcaaagaaactctttaaaaggtttgaaaaacatccggctgtcggtccatcaccttgattggcagctttcacgaacttgttgtttacatgagacatgcattccttcactataatttataggattccgtgagcaggtttccctgctcagcataagccctccagtttctctatcatccgaactaaatcctgatagcttaaattcttttgggataaatgcaagccgttgcttatacgaacctcaatccaaatacgaacaggagtatcgatgctgcctttggatacagtttgagggtgcatgacaggcatgggatttttctcattacccgcaacgggaataccatcaatctggacttcaactacttgtttactagtatccttaaaccatttgtaaaagatgttacaaggaactttgttcctaacacaaaacaattggagagattctccatgaggcaaagcctccgtctggtactgaaagtaaaacctttcaagatcttcactgctatacataatgataaaattttgcagcgaagatagaacttccaatcaatagccaattttggactgcttacgaaacagcaatatgtcatttttggacactaacgctctatatattttattactttacacggattacctgctgcaatgcaatcagctggaatactcttggtaacgacactgccactacctatcacagtacgcgcaccaataattacccctttcaaaataatacaacgagttccaatgagtacatcatcttcaattatgataggggcagtagcagcagctaaaccatcaactctatacccttgttcattcttctctattgacctacgaatattaaaattaaggctatgtgcgtccgtatccataataacacaatcaccaccaatctttacataattaccaatcgtaatactagtactagcccataaacaagccgaagatatgccagagttatcaccaatagtaatacgcgatgagggataaactgtgaacatacatccacaaatatttcgacacaaaggattaaacgcctctccactggtaaatacaaaattatcaccaattgtaattttactacttcgtgccttattcagataaattttattatatacccgcatgttgctaccgaaacgcacatcattcaaccagaatttgaagcgattaaagcaaatataataaatcatgtgtaaacgtcgaggtatacgcagggatttggctaaaaaggatcttatattcataaaatttaaacagatttgcaaatttcaagtcctaatggttatttcatattcgaggtctttggtaagataggaatggctatatatctgcatattcagtgcggtacgattattctatatgtcactttcaattgccaactaaaagagaaataaattctgagatgtttaacttctttggatgataataaatttagaaaattacaaaattgcttgtttagtcatctctacatattttctaccatatttcagatctggttctaaataattaccttctccccattcattccatgatttaacaaacaataggttttcttgctgcgaccttgtttgcagtttgttaaacatctgtcggcacaacttcccccacttttcaggggtattcccgactataatacatccacgatgtgcgctacgtggtgaatgatcaaaattaggcaataaacacggatgaatattagatcctaattgatattcactcaaaacacagtccatatattgttcatactccaacaatctaggaattttcaaaatttttctctttattttttctaaaaatattttcaatggaaatgtatgaaaagcataagcatcatatatataatctactgttacactatcaaaaccaagttctaaaatagtcttgatattttttacaccaaaggtaaaaccgacaaaataaaatccagctaatccattttccttagccagacgattccatatctcaataaaaagcttcacatcaggtatttctaaaggagcataaactgcaaaaagtaatttcccatcgacttttatataacgagaatctttaaaagctggaagcattgcattgaaatgagctatataatcatcaatgcctgaatatgtctgttctattaatagtttattgggtttatcggggtcccaagtcttctgataccatgaatgatttgcccaacaaagacagaaaggaaagttcggtttaccactatcaacgacttcggtaaatacccgatcaagcaacctacgcccattaaaccaataatgccaataacagaaaccttctatacctgcctcttttgccatttctgcttgttgaattctaaccttcggtattctcaaatcataataccctaaatctgcaggaactctaggctggtaatgccctttaaaaagcggctttgcccgaccgacatttgtccattcagtaaatccttttccccaccattcatcattttcagtagtaggataaaactgcggcaaataaaatgctattaatcttggttttgacattcttatttttatttaagccatttatactttatctttcctatcgtcatccagtcgcaaataatcaagttcactttctttcatgcgcattttctcaggatataaaatcttctcatgtgcaataacttgctttgaattgaaacgaatacccaaaatatgtgcaggaactccgcctaccacacaataagcaggaaaagaagatataacaaccgcccctgctgcaacaacacagccacgaccaatattaactcctttcagaattgtaacattagcaccaatccaaacatcatcaccaataattacatccgaatcatcttctggaagtttttcatgattatcaataatagcaacacctatttttctaatattatgatcaccatttacaatcgtaacatgaggacccaacatcacattattcccaaaaataattttcttatatatagcatataatactgcattaggaccaattgaaacattgtcaccaaactcaatcattgaagctgaattaataatgcaaccattaccaataatcacttttttaccttgacgagcaaattgatactttctatgcctaacaaaaacatatcgcagtatatttacaatttttcgaatcataattctatactcaatattctcaataaatatgcaatctttttatcacaaattcacttatttttttacgctctgacttgcgcaaacctaacatacatatcataattagagacaatataatgcaaaataatgaaacagtaagcagataccaaaagcctgtgtctgaaacagatatattagacaatgttagaaatgacacaccactaataacgatcacaacagaaaaaggataaaccaatgcattccacacatatttactaatagaaagtcctatcaaaatattacaataataaactctgataaccaatactagcaattctacaactacttgaacaataaaaacagtagtaggactatactcaaataagagaaacaaataacatattggcacaacaaacaactctgctatgccactccaaaagaaaggttttccaatgtttccttgtgatcttaagccaacagtcaacggagtttgcaaacatgttagaaaacttccaataattgtaatgcgtataaaagacgatgtatattcaggaacttcaaccaaccataatgacagaatatcttccaacctcatatataccggtaaaacaattatgaataacagataaatagaaaaccgagagctgtttattattaagaatagcatcctttcataatcattcattgcataagacttcgtaatctgaggggttacagacgtttgaagattagtactaaattgttgcaaagcagaagttacctgaacagatattcctctagccgcatttactataggagagaagaacatattcaacaacatatttatcaaagatgtattaatcgcataagggatatgagcaaataatccccaaccggctatacgtaatatttctttatgcaaagcaccataacctacaaaacataatttagactcttggaattttttattacaataagcccaatataaaaattgactaagggtttgtgcgacgactatcaatactccatataagattagtctatccgaatgaaaattatctaccacataacatattacaagctttaacaacacatctactaaagaaatataagcaaatgcattcattttttcatgtgaaataattaagccattatatggaatactaataatggataaaaccaatcctaataatgataattgaaaacaccagttagcggcaaccaatctgtctgccggaataaccattttacaattaagcaaccagacaccacaggtttcacataacacgacaataactaaagcaataaaaacatgaatcgatatactaacattaaatacggtatttagtcgcttataatttcgttttcctaattctatagataaatatctttgagtaacaggtatcaaacatgagttcaaaaaagagaaaagagtaactgcacttcctacaacattatatataccatagtctgtaattcccaacgctttcaataaaatgcgacttgtataaatcgtaatagccattattaaaagcattctaacataaagaatacccgtatttacagctatccgtctattgtcatttctcatttaaatggattttaaagcctagttatctgagcaaatgtatattccccatactatataatatgggagtaataacaaaccttttgattagtaaagctaaagccaacaaaactataaaaaagataatatcaaagagcagtaagccaaaatatgaatactcttgataaaattttgaagctatcgatctccaaaactcagatatgcaaggaacctcatgaatcataaaaactcccaatacagcagatgccattgaattaatccagtgactttgaatcttaattcgagaaaataatataaacactgccatagaagataaaataaccaaaggattattataccccataattctcattgtattaattgtattcgattctttatgcataagtccaaagaaaaatacaaaaatacaaaccaataatattgtagagattgcatatacagatatacaaagaatcattggtgattgcatattccatttatttatcctaagccaataccctatcagatataaaaaagcaaaattagccacgttatatccatttacattattgtattttaacccccatccaaaaacaacattaagcactgttaaaagaagaatgaacaatgtgcattcatcaatatttatatttttacatctaaagagaggaagagatattattttattagttctaatcaacttattaagcaagggtatagaaaacaggagcattatataacacacaataaaccaattccaagtaaaatctatagcatgaacgaaatcgggaatagaaaagcgcgtaacattaaacaaactcgcaattaagtatgcaattccactatagcaggtcacttctataagtaaaaataatatctttcgaaagatttttttatccgacacaccaaaccatcccgtaatcaacacaaacaaatttactccaataattacagcactatttaacaatactcccgtaattccctcattcaaagtgtaatgacctgtatacccaaaagtatcagcgacagctaatgaatgatgaatcaacaccataaatatagcaacaattcgtaataattcaaactgagactctctagtatttataagattcatattgctatcaaattagtaattaataattgatttagcaaaaagagactctaaagattttattttattcatacaagattcatcaagttcctcatcattggaaattgcttgataacaggccttatttagatttacaaaatccactctttcaccaaactccttcactgtacgtaaatatgaagcacatgattttatattattcaatggagatacaaaactttttaagattctaggtaaatcttcaaaagagtcgaccctatgtataccttctatgagactaaatggcacatttgaaaatacaacagcatgtttacctaacattgcagcctcataagctgcagttcctgacagcgtgacaacaccttgagatttagtaatccaaggtttcgggtcattataataattaagctgtaccattttagcatttggaagtctattgactgctttataaaattctatacttctttcacctatcattgcttgatgctcttttacatataacatccagccagccggaagactcttagaaacagcttctataacggataattcattcacatagaaaggtgtcaaaatagaagttgttgattcaggtattaaatgtaaaggcatataaacatacctctcgtcatttcgaggtacttgaaacatcttatttcgcctcatcaaacgctgtttataatatgtgtaatgaagaaaatatttaatatagcccattgttgacggatacaatatttgattagatctctttattttccaatttccggcaataacatcctgtttgaacagtaaaataataaaatgagcccaaaacttcacgaccttcaaaaatgactccggataatactgataatcaatagaattgacagatgatttattcttaatctccgctttcttacgatagtcttctacatacttaacctccgttgaaaggtcaatcttattaccaatctcacaacttttgaaatattcttcaaattttatattaacagaatttcccaaattataagtgtatattaaataatcatcaaagcgagggaagtccaaagttacattaggaatatctctcttgtagcaaatttcacgtaatgcattgcgagatatttcgtccgaatccgtattgataacaacatccggttgaaattcatctaatactttgagtgcatctttataacataatatcaaccaatttaattgttgttgataagtacaagatgaccaaaaatagcgataatgataatgcctattaaaactttgtgatgaaataatctgagtgttaatattcttaaaatgcgtgtattctttttctattttttctaaaaaaaattggtcaatcacgttatcatcattccgtatatttataaatatttcagcgatactattaacatcatatacttttaaagaaatattttttttaaaagcataataagtgctttcattagaagggtttttcttaaatccagactcacttgccttgataaaatacgcagcaacttcattgtatttcatccagtcttttattaaaaaataaaaaggacgtgaatcatcctccctacaagttatcaatattcgttttcctttgatttccatttttttcaacttatagtttcattgaaaggcctattatcaatattgttatataaaaattacgactgtgctattgccataaagtttttaatacttaaaatgcctcactaaatcattggctttctgatactcctgaggagtgcctatatctatccaagttccatttagaggataacgaataacagacaagccacggtttatcaataattcaatgaaatctgtagcattaaagaattccccttctggtatcagttcaagcaatgaacgcttaaacaaatatattccggcattcgcataataagtatatgtaggtttttctatcagcccatggatattacggtctgccacgtcaaatattccataaggaatagacaccttataaggcacagccgctacagacatgtccgcatgatgttgagtgaaatgcaaatagaagtcttcataatctatagtcgtaaaaagatctgaattcataactaatacaacatcattatagaattgtttcacaaacctaatagaccccatagtacccaaatattccggttctaaagccgtgtctatctttattccatcaataggtttgctaaaatggtcttctatctgctcgtgcaaataattcacagtaacattgatgtgcctaactccatagttaaccaagcgctctatgttataatctataatggctttatctccgactggaagcaaaggtttaggggtcttttccgtcaatggacgtaagcgttcgcctttccctcctgccatcataacaacatctatagggaggacagagcgaagtttctctatattatatatctcctttatatgatgctccgaatcaagtactggtattaatttgatatgtttattgcgcaattcatgtatatgtgaaacgatattcaagtcattttcatcaatatatgcaaactcacaaaacatcacatctcttaccctactatccagttcataattccctatcaaagcccgacggatatctccatctgtcagtgtaccgaccatacatccattgttatctacaacaaaaagggtcattgcagtgtctgataaatcattcaaaatacgtaaggcatctacaatccgaagagtatctgcaattatacattcctcattcatagctctatcattttttcctttattaacagctctgcaaatttccagtcaagcatggtatccaaatccaaagaatggagttcatccacctctaaggctacaatttttgtaaaagcatttaaatccttacttcgcaaagatctgacgttcatgacatacaccgatcctgtaaattcataaacttcaggagcatcctgacgcctgattattctaccatctcccttagactggactaaatatccgtccttattcaattcaaaacaatcataataaggatttgaagcagcttcttttacgctaaccaccatatccacatcagcagtatacttgtctaggcaagattttacatcatcaaccctacggaaaggagatgtaggttgtagcaatacaacggcatcgtactccttaccctgcaaagcataataatctaaggcgtgaagaatcactccataagtacttgcatggtcagaagctagttcggaaggtctcaaaaaaggaacaggcaaaccataatcctccacaacacgctttatttccgcatcatcagtcgatacacaaatattcctatcagagacaacacttcgggctatatctatactatggcatataaggggcttacccgctaaaaattttatatttttatgaggaatacctttacttcccccacgggcaggaattattattaaaagattcattctgtttatctaatttgaataggttcgtctacatcatagttctttgttgcccgttttccaagaatcaagttccaataagaagcacttatccctttttctgctctcttcacagtaagattatctacagacaattcctcaccttcttgaattcttctcttggctacaattgatttcaaaacaacctttgaaatttcaatctcacttttattgggtctttttataccatctcctaaagccaattctatattacgaatacagtctaccatatatttcaattcagcaggttcaagcgaagctttatgatcaggtccttccatctttcggcttaaagtaaaatgcttttctataatttcggctcccatagccactgctgcaataggtatctctgcacccatagtatgatcagaataacctattttacatttaaaggcatttttcattgtctgcatggcacaaagattcacctcagacatggggcaaggataattggtggtacaatgaagcaacgatacactattcgctcctgcctcaagcaaagtgcgatatgctatttccacatcactgagccaagacatacctgtggaaagaatgacaggcatcctgcattgaccaatacgcttcaaataaggtatattgtttacttcacccgaacctattttaaggaaaggaagatgcaagctgacaagaaaatccagactgtcttcctcatcgggtgtggaaagaaaatcaatgcctatcttgtcgcaatattctttaatttcgaagaactgacgataactaagttccagtttcttcagcatatcaaattgcgtttcttcgtttgaatgggtattctccacctgataagtggcttttgccgctgtttgagtaacaatcttctcagtcttccaagtctgaaacttcaccgcatccacacctgctgccttagcgacatcacacagacgtagtgccaaatcgagacgtccattatgattgacacccgcttcggctatgatatatacagccataatctcaatatttatatttcaatagaaaatacttataatgttcctttttatcaggattccttacctcccaatcagcacacaacgcctgatagacggtctcattgaaaagcaatttaccgatagcaaactgacaggtgtttcttgagaaacggcttttgaagcagaacagagaatcgtcctcgccagatgtagtgcctccaccaagatgaaagcgtctgactccccgacgcttcaattccaaagcggcattatagagcatataattattgggggacaaaccaagatatgccttgtcactgcctgacagatggtaatgcccataaggcggatggcagaaaaagatggcagcagaaagcacctcttcctctaacttcacaactcccaaaaacttattatcaatgcgctctttcaacgaccgataataggcatcattaaaataatagaagccatcggcagaaagcttgtccatcgtagaattatacaatctggcaaactgcggcaaataagcgaatgcgtcatcaaccacaaacttcaatccattcctgtcaccttttttaatgacattacggttcttggtatgaatttcgttcatccaaatgtcattttcatcaagagacagatccattgctatcgtcttacggtcaaaaatgactttgcctatactatcgaattttctgtaattgtctaacagaggatgaaaccgcacaaaacctgccacacaaccatgatttgaaaactcctgagaaagactcctcaaagctgcgacccaaaaactttcgttgttcacgttacatatcggtccaccataaccataagcagtctcaaaatcaaaaaatgtcttctcattgtacgtaaactcccgtttgagaaaagggaaaagcatataggagtcattctcataaatcaccgcacaataaggtttttctgtaggtgtttcatagagataaacatattcttccttaaaatatacatcatactgttcattggaaaagtaactgaaataccggttccaatgtggagtaaatagaatcttcataaacagttttttctgatgaataaatattgataatcaaaatattagagtaatatcatatctgttttaaattcattatcgataatttctctgcttatcattgagatagtcctttatatgctgcactatttgttcggaagcatgtccatcaccccaaaacttatcaattaaccggtaatcaacaatatatgatatagctttctctatttcctgctgtgagatgccacaacatatcacgttcttacaaatatggcgccctttttgacgattaccaatattaactactggaatacccaagaaaggagcttccacaatgccggatgatgaatttcctaatacacattccacttgggacataaaactcaaataacgcagttgccccaaggaagcaacaacccttacatcgtcatcttgttttgcatcccaatatttattgatctggctcccaccaaaatcggcattagccttagttactacaaattgtacatttttttgtccaatcattacattatagaggttctcagtcatttgcaaattataatcaagcgactccttggtttcgctatgaagagtaacaagcatccattgtttacttgcattcaaattaagttgctcggccaattcactacgtgtcatcagttgatgacgaagaaatgaatcaaggcccggttcacccactacatatatattttcgtccattcccaacatacgccgcagacgtactgctgattcttcagtgccaggaaaatgcagtgaagacatcatagtgacagcattacgtacctcattgtcgatagccccttctgtaatgtcaccacctgaaatatgcgcaatagggatattgaaaagaagagctgtgttgacaattggaagcaactcgtagcgatcgcccaaaatgacaatcatatccggcttcaagctacgaaacgcatagcttatcttttcagcacaaatccccatagaacgtgggatagaataaaggtcttcagtatgtagttccatatctatcttggcatctatggtatatccgtcatgctcaatgaaatgataggtcatgccaaactctttggacagatggctacctgtcgccactatttgaagattgacgtctttgtctttcgaaagaatgtcgattatccaacgaagcagaccatactctgagcgagtggctgttactacgcaaatatttttcatacatgtcttatccacaacgagaataaattgttttgagaaagaaaggggtaattcactatattcttgctcctaaggctcatgaaatccattctcggaaactaccatcctacttcctatatttttaattgaaatcaaaacggtcatcaataatagaacgttccatccatagccaacgcatagccataagctatgtgaaaccagcttgattaaagccagcagtttgatttctcacccttacttttggttcaggataagaaagtaatttgctacagataagacgttgtctctcataattctatgatatgttggaacaaaattgcaattctctataaaatcgccaaagaaatttacttattcttgaaaattattagttctccagccttacactactaggaatattcaccacccggtcagccagccactcggtattctccagcccgtccgtttcgcaatgctcgaacatgggcagtcgattcatcagttcccaaacgggacgggtcatcacaccatgatcatttgtgtactccaaaaaatcaagttgagcctccttatcctttagtaccaccgcattgagccaataattcgatttgcaatcagcaggttcagtaaagaaagtaatatcttccttacccttgaaaaactcaacataacgggcggctgtctcacgcttatctgccacatagcggtctagattctccaactgggcacaacctagagcggcattgatattcggcatccggtaattataaccaatatggtcatgacgaaactcccaacgatgaggtatcttagcctgggtagtaaggtgcttggcgtatgcgcccagttcttcatcctggaaaagcaacatgcctccaccacctgtagtgatggttttgtttccattaaagctaatagcacccacctttccgaatgtaccggtatgataccctttataaaaactgccgatactttcggctgcgtcttcaaccaattcgatatgccactcacggcagatatccgccagttcatctatttttacgggatggccgaaagtgtgcatgggaatacaagcttttacacgacgaccggtacgcttgttatagcaaactccttctttcagttcagcattcctctccagccatgccttgacagctcgggacgaaagtcccatcgtttctttgtccacatcaataaaaacaggatatgctccgatataactgacagcattgcaggtagcgatgaaggtcagagcttgagtgagcacctcatcatcgcgttctacacccactagcagcatggccatgtgaagggcattggtaccactcacacagactacggcacgcttggcaccggtgtacacagccatatcgtgctcaaagcggtcaacaaaagcaccgacacttgacacgaaagtcgtatcaatacattcgttgaggtattttttctcgtttccgataaacttgggagcactcagaggaacaaaatcttgtgttccaaaaagatggtgaatgaattcacagatttcagcgttgttattcatagctgtatatcattttaattacattttctgatctaaattcttccccttttcctcatgttcaaagttggggatgaaacgctttatcgccataaccacctcttctttggtaaaatccggttcggcaaatatattctccatttcagtaaagaatgcatctatctcagtcatcggccgtttcactacttcctcaatcacccctaggctgcaaaaacgatccatattaattttctcaccagaaacatagaactcctcgtatgccttctcacctgttgtatcacttttaaaatacaccactgggtaatccttattatcaaaagtcatatccgaagcaaatttcttcgcttcctcatccgttgcaaactcttttttctcgcagccaaccgcttttatatactcatcacaaatggaagagaaagtgagcatctgtctttcacccaactttgggaagaatatttcaccattcttacctagtatgcaggcaagcatacatatctggccgctttcctccggagaaacaaagtagcgtttcacatcattgggtgcagccaacggctgctttttcatgacacgctgtatccagccatccggcaaagaaccgttggaaaaagccacattggcaaaacgggcggtggtcaccttgaacttggaagaatacgccattatcatatcttccatgatgcgcttactagctcccataatgttcaccggattggcggccttgtcagtggaaacacagaagaaatgcctaggcgggtaaacggccaacaggtcaaggaatctttttgccttgatatcattgttttcaatgagtgcctgtaccgaatatttgtccttctcactacggacatgcttgtgagccgaaaaattcgccacaatgtcaaagcctttctcctcacggaagatcctttcaaagataggatcggcaaagttcaaggtatatgcccgatattccgcaggtacatacatgccgtatgtggaacgcaggtcacgtgtcagttctgccaatccgttctcgttcaggtctattacaatcagtttggagggcttgaacggcaagactgctttaatgaaagaagaaccgatggaaccggcacctcctatgacgcatacacttttattccttatttctgcttgaagcgtttctttattagcttcaatatctgctgcaaacatacttgtcggacgacaaatcacatggtctgcaatgaattgctgtaaattaaacatggatttattaggattagcatctcattttgacacatcctataaagaaaaccgcattaaagcagtttccctataaattgggtcaaaaattggattatcttttaatgcttatttaacgaaaaagtaagatatattcccaagcaaagtaagtagacttaaacagcaaagtaagtgaacttactttgcccacgaacatatcttacttttttccacacttatcaccggtttttcatctccggtcataaccgctttctcggtcgtcttgcccaagcgttattgatacgcgcacggatattgctgacagtcttgcccgatacgaacaaaggtgtgagaggaaagaacaacgagataaaacgctccttcaccatctcttccgaagtaatcttcggttcccgttcgcccatcttaactataaccctggccaattccaccgcattggtacattctgctatctgtaccagatagatacgtaaatcctccaccttatttatataagagaaaaggcgcatagcctcgggagataaagcaggttccttgtccatgcttacatcatccttctctagttccgcctcatcaccataataattctgtgtggcggaagtagcattgggaagaatctggttgctgcctccataaatgttgaagacgatgctgaagtgtgtctcactatccataagcttattgtttgaatgattcgtcaacgggtagttaacggtcagtcaatagctagtgaacggcagtcaacagttagtaaacgataataaatagatttttttacggtatttccccgcattaattttgtcgtgtcggaaggatgaacgaacatcccggaaacacaaaacttttaaactttattttattatgattgattacagtgtatttatgatgggcaacccgatggatgtcgatgccgcccaaaaagcgtatgcaaaagctcaagtttctgaaatcatgccattcagccagtttgtcaaacacattgccgaccacaatggcgtattcactcgcggaacggtaaaaggtgtaatagccgatatgtgcgagtgccttgtagaaatgcttctggaaggcaaaaaagtacaactggcagaattaggtaatttctggatttctataggctcggaaggtgcggaagacctgaagaaatttacagaaagcaacatcaccgccgtcaacattgtgttcacgccgggagaagacttccaaaatcttcgttcccgcgccgctttcaatcccgtagcaagccgcatagcccaagccgccaccctgaaggccgaaaaggccggtaaaggcacagtcgacttggatgccgccaaaggaaagaccccggcttccacaaatgaaaacaatccgtcattatgataaaataccacgttttctcgatgagaaatgcgtccgacaggacgatgcccaagaaagcatacgcaaagtgtgtgcccaacgaaacggtttcgcataagaaactcgtaaaggaagtgacggaacatctccgctttttcccacacggcatgatggaagcggtgctggaggaagtcttcaaccgcctgtccgagcatcttgcccaaggcgaccgagtcaccctggacggcctcggaacattcagtgtctccctgaaatgcgaaggagccgcttcggaggctttgttctccaagaaaaacatcaagggcgcgcacatcgtgtttgccccgtgtcgcaaactcaaggagacatttgcagatatggaatataaaatgactccacgaatcttttaacgtcatggaacttatattattcatctatttaaagacaaagcgtatgaaaaagaactggaaaaatgtactgctgtacatcgtccgcatcattgagctgctcattacaggcgctgccggaggagcacttggaagcggcttatgagaacggtttcgttgattatcgtgcactgctctgccaacaaggcgggcagtgccttgcgagcggaggacattgaccgctaccatcgttcattgggctggaagtgctgtggttaccactatgtgattcctacagacggaacgatagaagccggacgcccggaagagttggttggagcacattgcaagcaccacaacagccacagtataggtatatgctacataggcggactggatgatggcggaacaacgccgaaagacacccgaacggaagcacaaaaggctacgctgagaaaactgattgaacaactgcatcaacgttatcccaaggcactgattgtaggccatcatgacttgaatccgcaaaaagcctgtccatgtttccatgtcacagctgaatatatagacttgcaaccttagttgcgtctgtagtcttatctgccatccatcgtcctgcaagggatgtatggatggctttaattaaactaatcaattttttcaaacggaaacgcatgaagatagctcactgccaccgtcatattgccaaaagcgaataccagccttgtattgcggtgcaaacgcatgatacatccctctttcccccgaaagacaccaccggtaatacggattcgttgctttttctgaagatagtcctccaaaggccggttcatcagctcgatattgtaaggcatggattcatacagataaataaattcctccatctgacgttgaggaattaccgccgcacggtgtgtgttatagtccgtcaccagatactggcggggaagcatggcagacagaatacattccaactgccccaagggggcacatacaaacagccaaccgttgccttcaatccctttctcgttcgtcaacgcattcagtttctgagtggagccggtagcaaaagcctctttcaccacccgggcagagtcacggcgagcggtatattcctctttggtataagcacattgctcgaaacgtttcctatgatcggtggcagtgtaagaaaacaccttgaagcaaaaaaatctctcttctacggtacctgatggtgtacgaagccgaacagctttcctgccactgaaaacactgatatagcgtttcagttctttgttggaaagatacagataataccagccgagttcagggtattcttttcctattcccgccattggcgtgattccttcatttgaccccaggtctgagccggaagcgattgaactgcagagcagtaacttaggcgcttcgcccgttatgtcttgatttgaaaggaacgcttgattttcaagctccatactattttctgttaccatcaaaacattactttttatgtatgtctttttggggttctcttagtaagagaaccccaaaaagacatatactgctgacaataagatatttacacataatcagagatggataatttgcaaacaaatatcataagaatccttatcagagactgattcctgaataaaagatttccgtatttggattattatagctacatttgcagcggaatggggttctcttactaagagaactccattttttttattctaacagattcattttcaagatagatccaagaaagaccaaaaaggaacacataaattccttttccgcactcattaaaagaacaaatgataaaacgcaaaagcggccacttacgataaaaatcgaaagtgaccgctaaaaagagatttatttctctaatataaggatctaacagtacggagttacttcaccacaaatcctctcttatccagataagctttgaatttatgcaaatattcttcatccggaccatcaaagaaggatacaccggatgccccgttattgtacgcttcatccagcgcctcttcaaaattgtccttaatatcaccaaacatcagtccggcatatatcttggcacgcccattcaccgtttcaacgctttcctttaccgaacgcccgatccattcaggaccttcataatagaatttattataaatcatcggataataagcatccaacgtccattctccccaatcttggcgcaccatcttgcgagccatggacggccccgggaacactgcggcagaaatagctttatgatcggctttcaccgctttggtaatggcatccaccacacgagtgatggcatccagacggaaattgatccaactctggttttccatcggatactttaactccaacggatcctgtcctgttttagctttaaacaattcacggcagacatcacaataacaatagtcatattccggcaactcttctttctgctctataccatagtttttccataggctgacaggcaagattacatccggcatacggacataatccagatgaacaccatccacataaggcttatgggcttcctttacatagtcttctgccagatactctgccacaccttggtgattagggcacaagaagcgataataatccacgtaggccggtttgtcgtgacaagactcgcctttacggttcacggcataccagtcgggatgcttgtccagcagttccctgcggttcatcgtccatttccaataatgtgcctccagtccggcttctttgcaaagacgataaatattttcattgtatccctcgaacatgacacccgaaataccacattctttcaacaacgcaaaccattttttccattcggcatccgaacggttattcagacgcatccacaaccagtttttaacttcacgggcaggtatcttttctgtccggaaacgtccttcattatttatcacataacggactccttcagcaggattggttatagctatctgataggtgttctgagtcgcttccaccgcaatccgggcatcagccggaagatctttcaactctttatcagtcaaaaagaattgttctgtggcacgcaagtagttatgttgtttactataattatcctgctgtgcgtagaacatagcccatagcagtttatagatagcctgattgtacggataaaccaactcatcctgcgagattcccacttgcttgtctacgaaataaagatatccccaacggtcgggcatgtgcatatcgattcttccggtaggagtccatacccaattttcctcgggtcctttctccttcagccactgtacacgcgagaagttgatgcgccaggtgttgccggccttcaacggattgttaaagttcatggtcagcgcctgatgaggaatggccatttccacactccaatacttatctttatcttttgatttattcagtgtaccttcacaatggatggcggtcttcaatccggggcagtcccattgcaccatgaaatttccacccgaacgataaggtttgtccagcatcaggtcgaaaatcacgccacgcgcattggtttctatttcaaaataattgtgtccgtcgctatccggatcgataaatacttcaaagtcattgtcataatagatgatggtatcacgctgggtaagacgtgccttgatatcctcttcttgaagaacagctcctacatataaatattcatcatcccacagcatcttggcggtagtttcatatttgggagtcgggaatccttcgccgcttatatctacaaacggagcggtagacgccgccttcttccaggaactttcattcagtttaccatctattttcaactttccatccggacgataacatacataggtacgcggttcggccagaaaacgttcatattgttcaaaaaggctttgtgccattgccggaaaagtaaccagcagaagcaacagggtataaataagtttcttcatctatttttctgattcagattagttattatcttgcacttgtcccactccacgatagagtttgatcggtccatccagcaacacggccagcacggtaatctgctcatcctgtacctgttggggtacatcaatataaagattgcccggtactgagttccaataatttttattgtagaccttgtaattcaacatagctccgttaccaaccacccatatacggttcactttgttcatcagcccttttacttccaccggaccgttaggtttgtaaggaaggtacaaatacagaatatcccccgccttattcagtgtggtatatccctggaaatgctcggtaggaatccctgcgcgagtttcataaatagcttctttatgcttcttggtccatcggccgaactccttcaacacagcgatctgttcttcaggaatggaaccgtcctctttcggaccgatatccaataaaagattaccgcccatgctcaggcagtctacaaatgtacgaagcaagatatagggtgatttatagttgctgtctgtatgctgatatccccatgaatcattcatggtcatacaaagctcccaatatttatcctcgggacgcaccaccggcactccctgttcgggagtagcatagtcgccatatccctgtatgcgcgaattgataatcacattcttattatccgaacggagcagatctacaatacctttggaattccaagcttccgcactttgttcccagtctccgtcgaaccaatacagatccggtttccaggttttgttcagctccgccaattgtccgaaattgaacttgttgaatctggcccaacgttcaggatcatttttataacgtacttccgtacgggttttgtttgggtaatcaggatgagaccagtccaataaagaataatagaagccaagtttcaatccttgttttcttacttcctttacaaagggagctatgagatcacgttttgccggagtgcttttcacgacgctgatatctcctactttggtatcccataacgcaactccgtcatgatgtttggtagttatcactgtatatttggctccactttcttttatcagatccacccaagccttcggatcatacttggaggctgtgaaacctttttcctgctccatgtattcatcatagggcaggtagttgttaaagaaggaccagctttcggacactcctctgacggaataaattccccaatgaataaagatacccaacttggcttgtgaaaaccattccattctcttgtctttctgctcgactgtttcattctgtagcgtatcttgtgcccgtaaaggagaagctgcaatcagcagactcaggaacgctaacgataatcggttctttttcatatataataggtttgattagttaggatagcatgtcagtattattaaaatttacagctatataatggacaaagataatgtatttttatattttattctatctttgcacccctaaaacagaacaaatatgagcgcaaagaaaaagaaacaatccaatagtcccctgagagtcatcattattttagtattactgggacttttggcatataaacatcaattgtttgacgggaaactgcttgaaaatatccccactatcgaaagcaatgaagaaaagccagaaatactgacctcgccccagcatgacggtgcattggaaattccgatgatacaatcaagtacaggcggccagattctgaaacgtaaaggatataccctgtcttataatgccgattacaaaactccacaatgggtggcgtgggaacttactaaaaaagaaacaaaaggaaaagaagggcgaacaaataaattcttgcccgacccggacgtacgtggagccaaagcatatacgggagattatacaaaatcaggatatgaccggggacacatggcccctgccgccgatatgaaatggaacaaacaagccatggaagaatctttttatatgagcaacatttgtccgcaaaatccgaatctgaaccgcggcgactggaatgacctggaggaaaagtcacgccaatgggcaaaaaaatatggagccgtgtatattgcctgcggacctatatatgatactaaacgccccaaaagaattggcaacaataaagtggcagtcccccatgctttctataaagtcatattgataaatgataagaaaaatccgcaagccataggatttattttccccaacagcgccggacataagccactgaagaaatatatggtaacagtagacagcgtagagaaaagaacggatatcgatttcttccctgccctgccggatgaaatagaaaacagaatcgaagcggagttggtacaagaattaccgtagtctatcacacatacgcagacatgaaacgatacatacgtatgtatacccccacacatacgtatgtgtgggggcacacgaacgtacgggttttatttcacttccagcactacgatagacttggcaggaagagtcactttcaagcttcctttattgacctttgctccggtaaattctttcggggcaaccacattcggtttctcgaaactattgtaatcacctatattgttagcagtcagaatacggccggtaacactcttggcctttacctcacccaagttcaactctatttcctgcgattcctgcaaatccacattagacaaggaaatatgaatcaaaccgtttgcatcccgtgaagctgtagcacttaccatcgggacaatacggtcgtcgcgtacaatcttgcgttcacagttcagttccaaaggaagataagtagcatcctgatgcactttatacatttcaaagacatggtaagtcggtgtcagaaccatcttgtcgtcctttgtcaaaatcatagactgaagcacattggcaatctgggcaatgtttgtcatcttgatgcgatccgtatatttatggaaaacatccagtgtcaaagaggccacgaaagcatcgcgcaacgtgttctgctgatacagatgtccacggacagttcccggctcttcatcccaccaggttccccactcgtccaccatcaaaccgatttgcttcttcggatcatatttatccataattgccatatgcttcttcagcaccggttctatttccagacatttgcccatagtccaataataatcatcatcagtgaactgtgtagccgatcctttgcttccactccatcccatcactgtataataatgtaaagacacaccggccatacggtgacctacattcttcatcagtacttctgtccagttatagtcataatcactggcaccacttgcaatcttgaacaagtgattgccatcatagtcacgacaataagtggaataacggcggtacaagtctgcataatattcaggacgcatactgcctccgcatccccaactttcattacctaccccaaagaatttcactttccatggtttttcacgaccgttctccttacgcagtttcgccatcgggctaccttgttcggaagtcatgtattccacccatttcgccatttcttccacactcccacttcctacattaccgctgatataaggctcacaacctatcagctcacacaagttcagaaattcatgtgttccgaaactattatcttccactgtacctccccaattgttattgaccattcgggggcggttctctttcggaccgataccatccatccaatgatattcatcggcaaaacatccgcccggccaacgaagcaccggcactttcaaatctttcaatgcctgaagcacatcattacgatagccttgggtattgggaattttagaatcctcacctacccacaagcctccatagatacaggtgcccaaatgctctgcaaattgcccgtaaatatgtttactgatgatttctttcccttgctcgggatgtacattgatagtcgctttctgttgggcaaataccggcattgcagcgaacaatgccaagcccataagtgcatttttcatgattaaaaataaaataattaattatactatatttgcgttctcgtttttcgtttggtcaaatttacacattttacatcaaccggatagtggacaaaattgtatttttaggggtacaaaatcgtcaaaagtagaaaagaaacggatatttgcctatatttgcatacaaaaaagcccgatagactaaaatgaataaaaagaagcgtactattgtatggattgttatccttatcattatcctgacaggagcaggcggtgcaggaagtatatattactatttctttgccaaacaattccaacttacaaaaaccacctatatttatatagacagagatgataacctggattctgtataccataaaataatccggaacggacatcctaaaagtatgttcggttttcaatatctggcagaaaaagagaagtatggcgacaatatacggacaggacgttacgctctcaatccatcggacaatatgcgctacctcttccggcgtctttccatgggataccagactcccattaatctgactgtacccagtgtacgcaccgtggacagattagtgcgggccgtttcgcgccagctcatgattgattctctggatattgccaaattaatttccgacagtgcttactgtgcacaaatgggatatacccaagagacactaccctccctttttattcctaatacttacgaggtttattggaatatgagtgctgacgctttcatgaaacggatgcaaaaagaacatgctgccttttggaataatgacaggctgaaaaaggctcaacatatcggacttactcctgaagaagtgtccaccctggcctctatcgtggaagaagaaacggccaatggtcccgaaaagcccatggtcgcaggactttatattaacagattgaataaagggatgttgttgcaagcagacccgacggtaaaatttggtttacaggaattcggactgaaacgcattcttttcaaacatctggaagtggattctccttataatacctacaaacatgcaggtttacctccgggacctatccgaatcccatccatccaaggattggaaagcgtactgaactatacacagcatcattatatttatatgtgtgcaaaagaagatttctcaggcactcataatttcgcggtcacagcagcccagcatcaagctaatgcaagacgctatcaacaagcgttaaaccggcgaaaaataaaataaaaggagcggactataggtccgccctcccaatggattatttaatgtgtatctatagaatctttcagcaaccttcctttgtattgtccttttttcccggtcatctttccatattccactgcatgtaccggacaaacatggtaacaagccagacattgagtacagttacctccccaaacgggacgatccgtcactgttatattgcccacaggacaaaccttctcacacttcttacaaccaatgcaagcttccgttgcatgaaaaggcttgggagacatcagaaaagcattgaaaagagggcgcagcaaataggatttagtaaatggaagcgcaccttcatgacaattatattgtttcatttgagcccttgatgtaatttcttcgttgataaaacgcacacaggcaacagcattctgtactttctgggtttctatatctttatcatctacatcaaaaccgggcaaagaaacatacgtattcggcatagtaaccgaatagccggcaacacattgccaacctttccgggtaacggcagaagaaaaaatttgtgcagtccggcctgtatcatctccgcaagtacagacaaagaaaaggtatcccggcttatccaactttagctgatgaataaaacgaagtactatcttgggagggccccatgcatatacaggaaaaacaaaacctactttttccccttctttcagcttatacgctttgttcctgtctatttccatagctatggacaacaattcctcattctgtccttccgccagctgccttgccacccaagccgaattacctgtacctgaaaaataaaatatcatatccgtactatttttataaaaagaagcgatgctaatcttttgaattagcatcgccttataatgaagccgcaccagtgatgcgatgaaactccgaatgacaggttttgagtgctctcctcctttgtaatccaccggcataaatgctacccgaaggcgtggcccgccattggaagatgaagctatgtctcggttttcagattagtttgatgagtttcccaatccaactaatgcggctcgcttttcatctctttccgtatgacaaatatacgtcctttttatgatataaacaagagtatagcagaatttgtttgttaaaaataataagcaagaaaataactctctgtaattctgcttattgttgtttccatttattaaggaaacatcacaaggcatccgcaataaaaaagagcaacctcgtagagattgctctttcataaatctttatatcgccgtttacagaagaattaagcagcttttgctttagcaacaattgctttgaatgcttccggatggttcatagctaaatcagctaacaccttacggttgatttcgatacctgctttgtgcaatgcacccatcaatttagaataagacattccttctagacgagcggcagcgttgatacgctgaatccacaaagcgcggaaattacgtttcttgttcttacggtcacggtatgcgtaggtcaaacctttttcccaagtgttttttgctactgtccatacattctttcttgcaccaaagtaacctttggtaagacctaaaattttctttcttcttgctctagaagcaacatgatttactgatcttggcatagttttaattctttttgaatgttagcgccactgtttcacacggtgaacttaaagctaaagacattcggttaatactttaaataatacgtttacgctttcgttgtttttagattacttcatgcaaagcaattccttaacctgatccaagttagcattagctactagacctgagtgtacaaggtttcttttctgctttttagtcttcttagtcaaaatatgactgtgaaaagcgtgctttcttttgattttacctgttccggtaagaacgaatctttttttagaaccggagttagtcttgatctttggcatcttgtttttaattttaaattattattcaaatggtggtaacgcactataccggcgcgttaggcactcttttttcattcttttgtttctactgcctttttcggattttcctttttagcagtatccgtttctgccttcttcggagagcccgctttcttcggagccaaagaaatagtcattctcttaccttccaacaagggcatctgctctacttttgcatattcttccaagtcattcgcaaaacgaagcaacaatacttcgccttgttctttgaaaagaatggaacgacctttaaagaacacatatgctttcaccttgtctccgtcctgcaagaatccgatggcatgtttcaacttgaagttgtagtcatgatcatctgtttgaggtccgaaacggatttcctttacgtttacctttacctgtttagccttttgttccttttgacgtttctttaattgataaagaaatttagaataatcaataattctacaaactggaggaacagcattgggtgaaatttcaactaggtcagcctcatgatcctcagccatttttaaagcttgagctatcggataaactgccgattctacatcgtcgcccacaatgcggacttctttggcacgaatctgttcattgattctgtgttgcccttttaaactgtcattcttcattaaaaaacttttagttcctgtttgtttcttcttattttaattagtatttctttatcttaacgcaaaagaatacataaaggtttaacaatgcgctcttttgcaaacggctgcaaagttaccatttatttatcatattagaaacttcttcggcaagattttttccgaattcttctattttcatggttcctttgtcgccttcgccctgcttgcggactgcaacttcaccgttttcagcttctttctcgcctacaatcaacatgtaaggaatacgcttcatttcattgtcacgaatcttacggccgattttttcattacggtcatccacaatagcacgaacatcgaattttctcagttccgctttcacttgttccgcatactcattgaatttctcagaaataggcagaatagctacctggtcaggagtcagccacagcgggaatttaccggcagtatgctcaatcaatacggcaacaaaacgttccattgatccgaaaggcgcacggtgaatcattaccggacgatgcttttggttatctgagcccatatattccaactggaagcgttcgggcaagttgtagtctacctgaattgttcccaattgccagcgacgaccgatagcgtctttcaccataaagtccaatttaggaccatagaatgcagcctcaccatattccactttcgcagtcaggcctttttcttcgcaagcttcaataatggcctgttcggctttttcccaattctcatcgctaccgatgtacttttcgcggttcaccttgtcacgaagagaaatctgagcttccacattctcaaaattcatagacttgaacacaatgttgatgatatccatcacgcgaaggaattcttccttcacttggtcgggacgacagaacaagtgagcatcatcttgtgtaaaactgcgcacacgggtcagtccgtgcaattcaccgctctgttcgtagcggcatacggttccgaattccgcgatacgcaacggcaggtccttataagaacgtggagagttcttataaatcatacagtgatgaggacagttcatcggtttcaggaaatattcttccccttcttcgggtgtatgaataggctggaacgagtccttaccgtacttggcgtagtgtccggaagtgatatacaggttcttgttgccaataggcggacacattacttcctgataatcataacgggcctggatacggcgcaagaaatcctgcaaacggatacgcaaggcagtacctttcggcaaccacatgggaagtcccttgcccaccatatcggtaaacatgaacaaatccatttccttacctatcttacgatggtcgcgtttcttggcttcttccagcattaccagatattcgtccagcattttcttcttcgggaaagttataccataaatacgtgtcatctgcttgcggtcttcctgtcctctccaataagcaccggctacagaaagcagcttgatagctttgataggagcggtagaggtcaagtgaggaccacggcaaaggtcggtaaacgcaccttgtgtataagtggtgatgtgtccatcctccagttcggaaatcaattcacatttataagtctcacctctttcaccgaatttcttcaacgcatcctctttagcgatgctctgacgcaccaatatctctttctttgcagccaactcggccatcttggcctcgatagcgggtagatctgcttccttaatgattgcttcacccggatctacatcatagtaaaaaccgttttcaatggccggaccgataccaaactgaatgcccggataaagttcttgcaatgcttcggccagcaagtgggcactagtgtgccagaaagcatgtttgccctgttcgtcttcccatttataaagaacgaagtttgcatcttcattgatagggcgagataaatcaatcgtttcaccgttcacgccacaagctaaaacatcttgtgccagccgtgaactgatactttctgcaatctgcagaccagtaactccttcgttatattcgcgaacggagccgtcggggaatgttatctttatcataatcttctatttatattctttcttgaggatgcaaaaataacgaaatctttttgacttatcctctttttagcaaaaaaatgttattcttttcgttccgtaaagcgtttgatgatattgtaagcagagaaaagccccaactcacctgctttactcaggtcctgtataccttgcctgttgttacccaagaaaatatgtgtcaagccgcgattgaaataagcatccgcaaatttagggtccaactggatggctctgtcataatcaacaattgccgcacgatagtctttcaagatagaaagcacattacctctattataataagcatagacaaaatccggagccagctcaatcaccttgtccaaatcgcgctttaccatttcatagtccgcagctttcactgcactcttctctcccggaccggctttcaaatcatactctttttccatcttctggtattccagctgcttataacggatgagagcacggttgaaataaaccgggaagaaatgatcttctataataatagcctgattcaagtcttcaatggcacttgcaaaatcctgcaccagataaaagtccaatgaacgtgcaaaacgtttgttcacattattcggatcagccacaatggcagcagtctgttcgtcaatggatgcaaaatgttttgtagcttgttcttccgtcagaggagcttcctcattagttataatcagacggctgggaagtactttctgattattcaatgtttcaatgaacttataatagttgacctgtcgcttcacgtcatcatgcttttcataataggtaagcacgaacatgggctggggaacaatattcacattcttatcctgcacgcgtccacgatagtcactcttatatttttcttctccctcttcgttgtcggcaaccactatcttacgatagttgttcatgttcttatcggacttcttacgggttttattattctccgtattatcggcagtctgcttattaggatctactccgttctgtttatccagctgtgctttcaacaccttgaattcatctgcatcagcacctttcacatcccctattttcctacgcgcctgcgctctgtactgatatcccagcaagaaattgggatattcatttatcaccgtagaataatctttaattgcccctttataatctcctgtctgatccaacaacagaccacggttgaaaatagccatcatattgtcgggctccatttcgataacaaaattaaagtcttgaatagcccggttgtcatcgcctacttgtgcacgtaacaagccccggttataatggccgatgaaattattggggtcaatatccaatgcaatatcatagtcactcatcgctcctctcaggttattctgatggtaacgggccaaagcacggttgatataaacacctgaattccgggtggacagacggatggcatgatcaaaatcggcttccgcatctttatatctctgctgttgcagacgaaggatagcacggctggcccatgtatctgcatcataacggtctatttcaatcgccttgccaaagtctttttcggcagccaaagtatctttctgcttcaaatccacctcaccacgcatcaaataggcctttgtatatcggggggaaatggcgatcagcttatccagatcattcttcgcccccttataatcctcctgtctgatacggcaaagggccatattatgccatacccctatgttctcaggagcaaactccaacgccttggtataatcttctatagctcccgcaaaattattctgctggatccgtgccaatccacgcacctgataagcacttaccacaaacggattcctctcaatagcttccgaacaatcactctccgccccctgaaaatcatccaaatttatcttcgccagacctctatagaaataaggatcagacaaataaggctttgcattaatcacctgattgaaatattgaatcgaaaggacataatcctcaaaataaagcgcattacgccctatcgccatcaccctgtccgtatttatctgtgccgaagccactacagggaacattattaataatgtatagagtatccgttttatcattttgtatttataaaaatacggttttcccacaaatgcgccactggtggcgcatagatcaaaattgcggagttatcattttatagtcttgaccttataggagcaacgcgccttgcccttcagcatggcccccagctttcctttaatcatctgtttgcgtaatgcagacaaatgatcaatgaacatttttccgtccagatgatcaaattcatgctgcatgacccttgccaaatagccttccacccactcgtcatgttctttcagctcctcatccaaataagtcacatgaatacggtccggacgtttcaccgtttcatggataccgggcaaactcaaacaaccttcttccatgctgacttcctctccacccacttctaaaatatgaggatttatataggcacggcggaaatccttgaattcgggcaagtcatcagacatcacatccaaatcaatagttacaacacgaataggcagacctatttgcggagcagccaagcccacaccatctgcacgattcatggtttcaaacatatttgctatcaactctttcaaattagggtaatccggggtaatatcctctgcttctttacgcaacaccggttgtccgtacacataaataggtaatatcatttttcttaatctgtttttatttattaaatatatttcttcgactccaaataagactgtaagattatcgtagcactgatttcatcaaccaaggctttgttctgcctgtcttttttcttcaagcctccatccaacatggcttggtgggccaatacggacgtaaaccgctcgtcaacaaactctaccggtatatccggtattttttttcttagttgattgacaaaagggacaatattacgcatattttccgactcctgattattcatttgcttaggatgccccacaatgatgcgttccacaggctctttttccacatatttcagaataaagtccagtagttggtgtgtaggaacagttgtcaacccgtttgcaataatctgcaaaacatccgtcacagccacacctgtgcgctttttaccgtaatctatcgctaatattctactcatatagtttgcaaaaatacaaatttattccatacctattttatatataaagattaaaatatgctttttcaactgttttttctaaagaaacgattcatttcgtttaattttatttgctatttaaaaaatagtacttatttttgcaccgaatatgtggcttagcgtaagggtcgcataatgttaaattgaaacaagtatttgttataaaatgaaaaataagagctcttccaaaggagtttcatatagatgtttgttgtattgtatagctatattgttgcttgttatgattccattaaaaagtttcagccaatcaacaggagaattaacaacagacagtcttgtaaaaatgggatttgaaaatgtaagatggacagatactcctgaagaaagagtttatgtggttgaaaacagtgcttacaaaattcaagcgttgggcatcagaaaggctgtagatatcatacagtcgatgggattacccaaggacaaatcttgtaagttgattgttaccaactataatatacctcaggtctcacttacctatcagcctcttgccggtgacacaacagtggtaaacggtgaagactggaaagtcagttatgatataggtgacagttggaacaaggtgaagaaagaaaagaaaaagaacagttcgctgtttaaagtagatatattggtatatccgcagctatactttaagaactatatcattacacagatatatcaggctttattagagtttagcccggcggtagaggtgtcgctttggccaggaatgaaatttaccggacagattgtatttcctgtatacaatgatggatatggagaaacagccggaaaaattcatccaggatatttgacattagcacaaaaatttagattaccatataatatacaaagtacagtaactattggtatgtttgattataatacatatggtgcagatttaaatttgttttatccgtttaaagacgaacgtttttctttagaaggaagaattggctatgtcggatttggatattggcatggttttaaatttcgctataatgataaatacactacttattggtctgtagggggaaacttttactggccaaggtataatacacagtttaaattgagagctgaacaatatttattaaaagaaaaaggggtaagatttgaaatgatcagacacttccgctatgccagtataggtttctacgctgtaaaagcagaacatgccaatagtaatggagggtttaagttcatcgtcgcattaccaccttataaatataaaagacataaatatataccaagggtttctacctcattgggtacgggtataacatataatgcaggaaatgaaaaatattattataaaatgccatatagtaatgcaagtgacaatataatgcaacaaaatagttttaatccatattttattaaatcagaattattaaatttttaattttattgagatgaaaaagaaaagttttttgagcggtattggtgctaaattagcattagctgcagtagctttaacaacagtagtgtttacaagctgcgaaaaagaagaatttaatgtagaaccggtagaactatcacctgctagtgcgacgattgttgccaccgtatatgatttgacaacgggtgaagttcttgctccccaagcaattgttgaaacaatcactgcaggtacagatggaacaattgcagctactacaaaagaaattagttgcccctctttcagcaatgcagaatatctgccagtagaagccattactgtggcaattcctaaactagcaaaaggacagtttgctcttattccggtaaatttctatgctcagaaaatagtttctgctgctaaaaatgtaacagtaagcgaagacccaactacaattgaaacaactgaagttaagaatactcctgttacttacggaccttatgatgtagacaaaaatatagatattgaatatgcagctaaagtaggttcagaagttgttaatattaatgctattaacagttacattgaaactcttgttaactcaagagcaatgagtaacgaaaatgttatcaaggttttaaaagcagtagtcggtacttacaatacaggtattaaaactgaaatgcagaaagaaacaagaactatcaaagctcaaactactgtaacattcagccctgtaacaacaattattgaatcagtcgttactgtaactgcaacagttgatggagtagaatatactattcctaatgtacagcttagaaaagctggtgcaacagttgtttctgaatcttcagaatcacacgcaggtcacgatcacggtcatggagataacagcaactcaggtggtggtgcaggtggaagataataattaatcatctatcggttatttgttcagttattcaccaaaaaatataataaaaatgaaatataaattcttaacactgtcacttttgttggcaggagcttgtgcaactacggttatggcacaagatactaattattatactccgaaatggagtgataacatctttgtcagtgtaggtggaggtatccacgctattgaaaacgatggtttcaataaactggctcctcacttcagtatctctttgggtaagttaattactcccacatggggaatacgtggtcaagtaaatggtatcacacaacacttgtgcttggataacagttactaccaacacaacaagaattatgtaggagctaatatcgacgctatggtaaacttgtcaactctgtttgcaggtgctaatcctagccgtttctttgaagtttacggttttgccggtcctatgctttctgtagctaaatcacagaatgtaacaatcaaaaatgatggaacaatggttcccgaaggtgaaaataaagtaagagcacgtatcggtgcatctgccggtgtaggcttgaaattcaacattaacaaatattgggctattgatgttgaagctcgcggcgctattgctccctctatctttggtaatatcagcagccaccgtaaagctgaaggaacaggtatgttgacagctggtgtcagctacatcttcggtggcaagaagtttgctaaagttgaagaccgtgtagtagaaaaagaagtgatcaaggaagtggttcgtgaagttccgaaagaagtagtcaaggaagtgattaaagaagttcctagcgctgcagaagttgctatcttcttcaagatcggtaaagcaaagatcagtccggaaggcatggttaatgtacagttaatggctaaagctatcaaagctaatcctaacgctaagtacaaaatcgcaggtttcgctgataaagctacaggatctgcttcattcaaccagactttgtctgaaaaacgtgctcaggctgtttacgatgcattggttgcagaaggcgtaaaagaaagccaacttgaaaaagttgctatgggtggaacagacaacatgtttggcaagaactatctgaaccgcgtagttattctggaagtaaaataatcattgctacctgataaaactctgataaattaaagaagggggtatcgtaacaaacgatgctccctctttttttcttcaactgcattttaatcacataagcagcaacagcaaacaaaccgtataacaagaatctacgaatcttggctatacaattccggaaaccagaggcagcatttaccgaatcttgtaacaagataccgggctatatcacaaacaaaaagcttttttaaaatactcccaggatatataaacaaagggcatataatgttgcaggtgcaagatatatatcttgcacctgcaacattacacaaacaaaagcatttacttatcttcaatagaccagcttcacattgtcaacccaaagcgtatttccgggagagccgataaaagctcccccatgactggacgaaaattgcagtatcatgtgggtaggattctcattggcctccgcccatcctgtttctttaatcaagacactttctcccttactatttctagtataatctcgctctctcaaccccatcgtttcatgatcataagacggatgcttggttatatcaccatacagcacttcataagtagcaccattcacccaaccatccgagtccttatcatacttcaccaccatagttcctaccctcttcgcagtaatatttccttcagcgtcctccatacgtttttgcaaaaagaaaacagttatcgcacaatcctgccctgccacctgacctttcttgctgaagcctgtcaaccggatacgatctttctcaccagacatctttaccttataatcataacggacagctttgggacgttgggtaaaaggaactccccaattcatattcttctcagcattcttggttcctgttatcggctccaacatatcacccaaataaatggatccggctgccaatacagtaatattcaccattcccaataccttgacgctctctatatgcgtttccagacgagcacaatatccattgtcccgtttgtccctgtaaacagaattatttgttttaacaatgcccactaccttagccatcacattagaggttccccaaggagaccctcccatattcttataaggtttgttaccatctatttcctttgtagggcctatctcataaagaagtttggtattgccgcctataacaccggactcatgaaccttacggattatccactgatccatatctccgtattttataggtaccaccttttcctgggcaaagccatacagcggtgctatagccaaaagagcagcgaccgataatctgccataatatttcatacccttagtttttattgttgtttagaaccggcaaagctataaaaaaaagcggcaacttcacagttgccgcttttaataaagaaaaatagactatattttcttcttaatttaccaaaaagaaatcattaatatactctatatagtaaccatgccttttggaaatcgtcacggttaggatattttgccttaaattcctcctttgcctgagtagcctccgcacggtcatcgtatgaagatgctataacgcgatacgtatttctttcagcattataaaccactttggcattatagccttggccatccaaatattgtttcagaccttccgcattcgctttcacgccaaagctaccacatactacgctatatgcttttaagccgtcacctgaaaccagttctactttctcttcgcgaaccggaccggcaacaggagcagttgtcacgggggcagatactaccggagcagcttcaaccggagtcgcttctacctgatcggcaggagcttcagccaattcctgttgttttgccttttcataagccttcttgtaagcactttcgctagatttacatgaggaaaatgccaaggctacgcacaatcccatacccaacacaactaattttttcatgattactcaatcttttataaattaatactctagtttaattccattatattggtgcaaaagtagcaatatatcaacagctttcacagcaagaacggagttaaatttagttaatcagagaagaatctccaatttctattcaaaaatagacaaaataaacaacaacattcagttttatttgttagatttgtaaggtacaaaaaacaaaaaactatgaaaggattaagtattttagctgcattcctaggcggagccgtagttggtgcagcagccggtattttatttgctcctgaaagcggagaagacactcgtagcaaaattgctgatgctttacgtaaaagaggtatcaaattaagtcgcacagatatggaaaatctggtcgatgaaattgcagccgaggtaaaagaataagcaacgcccacaaaagtgtattgtcattccggatacaagtccggaatgacaataatttttaaatcaaaactccacgcatgtttgcaaacgataaaaatatagataatctgcaacaacttctggcagagcttaaaaagtacgcagagttacaaaaggattatgtaaaactacatttagtagaaaaacttactatactgatatcaaccctcatccttgtctttatattattgatattaggtattatcgcccttttctacttatcatttacattggcctatgtactcgcacctcatgtaggcgggcttatggccagttatggaatcattaccggatgcattattctgctgattctgttaatcgttttattccgcaaacggctgattgttcagcctatggtaaatttccttgccaacttgcttttaaatgacaactgattatgaaagagaatactcctaataaaacgcccatcatcactttggaagtgatagcacaacgaaaagctgagaagttggaagaagtacagcaagctaaaaaagaaatggtacaaaccatacatgaactttttgcgcctgtagaacacaaaggaggcgtagaaggcattatgcaacatatcaatacaggaatcgccgtttatgacggagtacggaccggtatcaagatcatgcaaagaatcagaggatatttcctgaaaaaaaagaaataacttagtattaaccacaacattttatccacatgaaaagacagctactaggtgtggcggcaattttgttgtcaatttccacgtatgcacaggacaatccattatggatgcgttattgtgccatttctccggatggaaccaccatcgcattcacctataaaggtgacatctacacagtaccctctacaggcggcagggccagtcagattacaaccaaccctgcccacgacaccaaacccatctggagccctgacggaaaaaaaattgctttcgcatcagaccgaatgggaagtatggatatttttgaggtaaacaaggaagggggtatccccaaaagattaactacccattcgggtaatgaaacaccggtggcttataaagatgccggacacattctgtttctagccaatataatgccaacagcagaagacgcacaattcccctccggacaattccaacaagtatatgaagtcaataccgaaggcggacgccccatcctcttctcttccatgccgatggaagatatcagtatcaatcatacaggcaatactttactctaccatgacaaaaaaggatatgaagacccttggcgtaaacatcacacttcatccattacccgcgatatttggctgtgttctctgaatggaaaccgtacctttcgcaaacaaactgctttcaatggtgaggaccgcactcccgtttgggcttcagatgataaatcattctattatttaagtgaggaaaaaggctcatttaatattttcaaacgtgatattgacggtaatacatccaaacaaattaccaaccataccaaacatccggtacgcttcctgagtgccgcctccaatggaacattatgctatggatatgatggcgaaatctacacggtaaaagaaggtgccattccgcaaaaagttcagatttccattgtcaccgacaagaacgacaaagatctcatccgccagatcaagcgtagcggagcaacagagatatccctttcgtccgatgcaaaggaaattgcttttgtactacgcggagatgtatatgtcacatcaacagaatacagcactactaaacaaatcaccaatactccgcaacaggaacgcgatattcacttttctccggacggaagaagtattgtttacgctgccgaaagaaacggattatggcagatttatcaaaccagtctagctaaaaaggaagaaaaacagttcgcttacgcaaccgatatcaaagaggaaagactgaccaattcggatatcacttcattccaacctcaatacagtcctgacggtaaagaagtagcctttcttgaaaaccgtactaccatccgtgttctgaatctgaaatcaaaagctgtacgcaccgtcatggacggcaagtacgaatattcttatagtgacggcgaccaatggtatcaatggagtccggacagcaaatggattcttaccaactacataggtattggcggatggaataacaaggatgttgcactggtcaacgcatctggtaacggagaaattcataatcttaccgaaagtggatacagtgacggcaatgccaaatgggtattggatggaaaagccatgatttgggaaagtgaccgcgcaggattccgcagtcacggaagctggggtgctgaagcggatatctatatcatgttcttcgacctggacgcatacgaccgtttcagaatgagcaaggaagagcttgccttactggaagactcggaaaagaaagacaaagagaagagtgaagagaaggagaaggccgatcataaaaaagataaaaagaaagactccaagaaagaagatgacaagaaggaagtaaagccactggttttcgaccttgaaaacagccgtgaccgtgtgattcgtctgactgtaaattcttcacgattgggagatgctgtattaactccgaagggtgacaaactatattatcaagcagccttcgaaagcggatatgatttatgggaacacgatcttaaagaaaacaagactaaaatcgtcatgaaaaaagtcggtggcggagccctgcttcctgataagaaaggcgagaatctgttcctttgcagccaaggtggtatcaagaaagtcactgtcagcagtggtgaaaccaaacctgtagaattcgaagctttcttcgactaccaaccctatggtgaacgcgaatatattttcgatcatgtatggcaacaagtagaagataaattctatgtaaaagatctgcacggagtagactggaaaggctatcacgaagcatacgcacgctttcttccatacatcaataacaattatgattttcaggaaatgctgagtgaaatgctgggtgagttaaacggttcgcacaccggagcacgttactactcaaacggtcctatactatccacagcgaccctaggagtattctatgacgaaacttatgatggtgacgggttaaaaattaaagaaatattggcaaaaggcccatttgccgtgaaaaaaacggatgttactcccggttgcatcatcgagaaaattgacggcaaacctatcgtgaaagggcaagactacttcccgctgctggaaggcaaagccggaagaaaagtgttactggccatatataatccggctaccggcaaacgttttgatatcaccatcaaagctatcagcatgggcgaacaaagtaacttgctgtacaaacgttgggtagaacgttgccgcaatatagtcgataagttatccgaaggccgcatcggctatgtacacgtaaaaggcatggacagtcaaagtttccgcgaagtatatagtgaagtattgggacgctgccgcaacaaagaagctattattgtagacacacgccacaatggaggcggatggctacatgatgacttggccactttattaagcggcaaggaatatcagcgtttcgttccacgcggacaatacataggcagcgacccattcaataaatggctcaagccatcctgcgtattggtatgcgaggacaattacagtaacgcacatggcttcccatgggtttacaaggaattaaagataggcaaactgattggtgctccggttccgggcacaatgactgccgtatggtgggaaaaccagatcgacccgagtattgtgttcggtattcctcaggtgggttgtatggatatgcgtggacaatatgcggaaaatcaccaactttctccagacattgaagtttataatactccagaaaaggcattggcaggtgaagaccagcagttggaagcagccgtacaagaaatgctgaaaacaataggggaaaagaaataaaacaatcccatcctgataaaaagaaaaaggtgtcaaaacacaacctttgaggaaaaggacttttcatccgaggatactttgacaccctttatcagccataaaaagagccgtatcaactctactcccaagtaatgatacggctcttttttatacattacagcaagataatgtatggggcatctatgctgagcatacttaaatatgtcataatgatgctctataagttgttcccactcatgccctcatttccaactataacccactcattgtaaagtcattaccctcactccttattcctcattctcatctcttaagacactcattcacaatataatatacattcacaagcctataaaccggttatttggtaagccccctgttttttcagtttttcttccttgcacaaacggcataaataacggtgtcgtagtttgtatcatactgttcttctttgacgattaaaagttcaatatctgttaatcacgaatgtaattaagtctaatcactattgtagttaactttaaccactactgtaattaaacttagtcacagtagtgaataagcaattacaaacatataaaagtgagaaaataaaagggagaaaacagataagagacagggaaatatgcatacatagactaccgccaactcgctgcacaagccatgcagctgctttataagaacgaacgttatgggttgaatgatgaaaatgagaaggtattttggcaaaacaacaccgaatttgagtaaatttcgcctttggaacagttgtttaaatgtcacttctattccgccactacagagaagaagggagaaaggctgaccgcacatgaagattttcaattatttgcaagagtacaagcgtgaaaaacctgtcaatcaacaagataaattaatacagacacattatccgcaaactgaacattcacccaaaagccagcagaaaaggtactttatatcacatgataaagttagaataatttattttcaagcatctgtgttagtgagggcaatgccctcactaacacagatactaccatcactaataagcagttcattataaaccagttagagccaaagtgagggcatgagggcattttcgcgtccaactttctatttgttaagttgaaagggatggcttctattctccggtatgaaagacaccatttccggcatcgcaccaacttatcttgctctttctttccaaagacgagtcatatcttccaaagtctttccttttgtttcaggaaccatcttccacacaaacagagctgcaagcacacaaatcacgccataaagcccataggcaaataccggactgaattcatacatggcaggaaaagtggaagaaaccagataattgaatatccactggaaagctacagcgatagccactgccttgccgcggatagtattcggaaatatctctgcaatcaacacccagcagataggtccccatgacatcataaagaatgcagcataaactatgatggaaagaacaggaagaatacctcccacctgaaactcatcacaaaacgcaacacagaatgcacctacagccatgccaatagaaccaacaatcaacaagggtttacgtcccatcttctctacggtaaagatggcaatcaatgtaaagagaatattaaccacccccattaccacagtctgcatcataccatcgccaccgccaccgattttttcaaaaatacgcggtgcataataaagcacagcattaatgccgatagcttgctgaaatacagaaagcaagatgccgactacaataactgtcagcccgtatgtaagcagtttttccgttttctcggaagtcacagcctttatttcagacaaaatagttttagccttatctgttccatttactttttcaagtacagaaaacgctttatcatcctgatgggtcatagccaaatagcgcggagtttcaggaaccaaaaacaataaaatgccaaataatgcagccggaaccgcttctgaaccaaacatatatctccaaccatcggaaacaagcacttcatccggcataccatctttaatcatataattgacaaaatagactaccaacatgccaaaaataatagcaaactgattacaggaaaccaatttaccacgaatttcggaaggggcaatttcggcaatgtacatcggacaaacagcagaggcaagtcctacaccgattcccccgatgatacgataaaagttaaaagcaaggatcaatgcaaacgaagtatctcctttagagaaaaataaaaattcgggataataagagcctaaagcagacaggaagaacaataaagcagccagacgcaacgaattacgacgtcctagccccgaagcaaaataaccggaaaaagcactgccaatgacgcaacctatcaatgcactggaagcagtcacgccatgccagaaagcatctaatcccaaatgtttttgcagagcctgctccgcccccgaaataacagctgtatcataaccgaaaagtaaaccgccgagaatggctataaacaccactcccatcagatagaaattgtttttcttgtttttcataataaaagaattataatagttttcgtaataaatacaataacaaagctgtgcgaaaataatcattaatacgtaattctattataattctccaaccattttaaatctttttcacatcaaggaaaaacaagattattccgtctgaactgttctatgtcttccttttttaatcctatcttatccaatgacttaggaagattatggtcattaagataataacgcggacgaatgagatattgtctgtttgctaccgataggctatctgccctataaggtgtctgtacccctgccaaattcagcatggtatgaaacacggaggcatttcccgccaccggtttttcacggttctgcaatatagcttcatgtacttccacattcttttctctatatgttttggacaaccaaattaaaaatggtacatgcagttgataataagacgggaccggggatgcgtgtaaaaataattttcgattatcatcaaaaatatcctctccatgatccgaagtataaagcatagccgaaaaagagtttgttttctgcaataaagtgatcaaagaagccaggaaaccatctgtataacggatggtattatcatatgcattcatcaaatactctttattctcatatttggcgtctgtcagattatccggtttaaagacagacatggattcgggataacgttctttataattaaaatgtgatccataggcatgcagcacgatgaataatttttgatgacctgcctttagctccttttctaccagaaacaatagttcgtcatccgaaatattggctcctttcggagcatctttcttgataaacttccaatcatctgcctccatccccaaaaaatcaataaaagaatggttaggaagctggttcgaaaaaaaggcagtatgaaatcctgcttccttgaaagcggtaatgattcctttctgtctataaagacagtcataatcctcagccgaagctgccgaaagcaacataggcacacttttatgagtagtattagactgggtaagcacatccgtgaaagttaccaccccctccattttatcaagtaatggagtagtattcctttcataaccataaagtccgaaattacaggcacgggccgtttcccctatcaccaagacataaacttcccggctgttttcatcatgtgcggcactggcattaaaagtaaaatcccttgaagtttccgcatatccggctgtttcgcccgcacgttctgcagccaatactagattataacatacattagccggatacatttcgatctttacttgataatcacgttgcgtcgcatagcagataacggtcaataacgctcctgcaacaatgcctgccaaggcatacttacgttgagaacgaataaaagaatattccaactgattaccccgggcccatgaaaaacctcccaagaccaaagcaggaatgtaaacaacaaaaacaccaattacagccggcagtaaattatccaacagttccagcgcctccccggaattagtagttgtcagattcaggaacatatctactgcaatgatagaacgcccgaacaggtatagcaataccagttggaatgccgcaaagaaaacaaacggaaataagatccaaatagtctttccaggtttacgccccaatgtcataatcaaccaataaaccgataccggcagaatgacattacaaatacgtgcccaaagtgtcatttgctgttctgtaaaaaacaatgccacattgggaatggccaagacaacgatgaacagaacgaacaaccgttgtggctcacaacaccactgaataaattctttaaaatgcttcatttatattaaagataaaaccagactgtccattttttccaaatccatagtccagacgaacatttacattctttttaaactcccaacgataacctattccataattaggcaacactctgtccatgcacaaagcactgaacttattgaatacagttccggcccctatccaaactacaacaccattacgtttccatacatgctgacgcaattccacctgcccctctattttatgcttgtcacgatagcgcccttcgtaataaccacgcatggaatacgagtttcccaacaacgccatcatggcccatgacggattaccgaaattaaaagtaccgcgtaattctcctgccaacaatcctcctttccatacaggatgataataactggtacgcaaatccgtagtactgaatgcataatcgtttcctaaaaacttaggacggaaacactgggtaatattcaaataatatcccttatggggattggtcaacacatcgcgcgaatcatatgccaaagaaaggcccactccataattagcagtagtaagattcatcccctccagtagttcggggcgttccatattcttaccatgcacataatcataagatgccataggacctatatatagattatccgctatccgaaacaggaaactagctttaacttgtgcttgccagcgatctaaatcagattcattggcatctaccttacccatatcgtaccctattccccaaaacttggaaggaaaggaataaaaataaagagtataatccagccggtatttgtcctgcggaaagatatgagttccgcgtatccccaacatatagaagccaacagtggaaacatctccgaataaagacacattggacggaggaagaagcatgtcatttctatcggtacgataaagccccgccgccaccagtcccagccccagtttggtatccgtactgtaatgtggtccgccaataatactgaaatcaaatttcttatgattcttatctttattagcatcattaaaatagtccagaaactttttgaaaaaagtccttttctgtactgtgctgtctttgtgttgcgttgtcgtatcttcaggcaaataaaacagcccaccctcttgcgtgactgccaaagccgcatctgccatacatataaagattacgatccaaaatgatattttcttcattgtaatctattcttttttccactgttaaaacaagctttacagtaaacataaactgaataaaaacaaataaagcaggtctggatacaaagatagccaaacctgctttattgtgacttttttatataataagaatctggtctgaatttacctatttctgtcctaaataccttataccggttgcttttctgtaatcagccaacgcaatcttctgctcataataagattggataaggtttgtatatgcctgtatccatgtcagctgtgcagaaagcacatccaaaatagtcaacttaccttcagtataactaaaagtgttcaaatccaagttctcttctgccagtttgcagttctcctcggcaatacttatctgacgggtattctcggtcagactagtccacgccttcgccacttctttgcttatttggtcttgcttatcttgcaatgcatactgcttgcttaataaaatagccttctgtgcagccgtcgatttaaagcgggctccccaatggaaaatcggcaatttaatagaggcatacacattactattaaacatagtttcgcccgaaatgttcaacatctgtgttccccatgtctctttaaaaccgatagaaagagaaggattgtacttggcggcagccagacttacctgtcttttctgataatccacatccaactgtgagatagcataatcgggacgcacattcaaggctgtttccgctccaataaaggcaggcataggcaatatggtagaaatagaatccgtcaaatccatttcagccagcggttccaatcccatcagcacattcatattctgcaaggcgacctgataagactggtagctgctggaacgttgcaattcagcctctttcaaacgggtctgcatctgaatgagatccgtcttgctgatatagccatcatcgtacttatcttgcagcactttggtcaactgctcaataatctgcacatactggcacatcgtttcatacatttctttttgtgcggctgttccccaataactggcttcagcagcatagataatattatccgttgtcaaatccaccgacttatccgccatctgggtttgtatttgggaagccttgtaattgtgatagatgcttccaccggcataaataggttgtgatacccctacttcggcactgtatgaatcgtgctccataggaacagccattccgccaaaatccatctcgtatttgttaatacgatactgatagcttcccgttgcatcaacagccgggaagaaagcggtttttgccgctttcatagccttctgcatagctgtacgttgtgccacactctgttttaaggtttggctataatccagtaccttttgttcaaaggtagaataatccacgacagtctgagccgaaagtgtaccggtcatacaagccatacctataatatagatcatcttagttttcattatctgtctgctctgattttaaagaaaatacaataagttaccggaagaacaaaaatggtcagtaccgtcgatacgaacaaaccacccataatggtagccgccatacctgcaaacatggcatcgcccaacaatggaagcatacccagaatagtagttccggaagccatggtcaccggaacgatacgtgtcttggtagcctcgaccacggcagacacagccccctttccatccttcaactgaagtccgatttcatcgaccagcacaatggcattcttgatattcataccaatcaatcccaacagaccgaggatggcaaagaagtccaatgacttgccaaacaagagcaatccccataccacaccgataaacaccagcggcaacataagcataatcaataccggcttgcggtagttgctggggaaaagaaacagcagaaccacataaatcaacaggaaagtcagcggaatattcttcgccaatgcagcattacttacatcctgtgtttcctgctcaccgaaatatttcattttatacccttcgggcaactgcatctgctcttgtacggcagtaagcacctgtttaaacgcagccatcgtattggctccacgtttaggttcacattgcatcatcatacaacgctcgcggttaaagcgacggactacattataatcataacccaaagcgaaattatcgattacctgttccactttcacggaatttcctttcgtactgaatacaggcacacttttcacatcattcaagttcattttttccacatcctcatctttcagcaggataggcaaggaaacatccccctcacgatattctcccaaaggcaaaccattggtagccgtacggaatgagttggcaacctgctgacgggtaatccccaagcgtaaacctttctgttgagagaacatcggtttccacacgggcaccttatctccccagttggaacggatatccgtcaccatatcacactggcgggctatttttttcgccctttcaaccaatgcggtcaatgtatcgggattttcaccgataaaaccgatctcaatagcagcttcaggcaccggagacaaagcaaaaagtgccgaacgggtaatgatattgggaaagttctgagtcatgtgctcataaaactgctgttctacttcggctgcatcttcggggtctttagtttccaccatcacattggcatagttagacttcggtccaaaagaagaacttgccaaatagtaacgcaacggagtaccacccaatgtcaccgaatatgatttaactttctcatgattcttcaagtaatcctccaccttcatcacatcctgatctaccgcatgaatactaaatccctcagggaataccagatcagcacggaaataaggcttattcattttcgggaaaaaactctgaggcataacagccataataaccaaagaaagcaccaaagttacaaaaaccgtggtcaatgtcacaaaacggcgtttaatcagcaaggtcagaaacttctcgaatttatgatagagtttagtatcatacgggtctttcatcgcaccgccgggaacagcttctttcaaaataaaattaccaaaagtcgtagtctggcacaaagccagaatccagctcaatcccagtgatacagccaatacaacaaatagcggtttcacaatctcagccacggatgccggtgccagatacaaaggcaggaaagagcagatagcaataaaagtagcgcccagcaatgcccattgcggcttgatggctccctctatcaatgactgataacgtgattttccgcgcttgatacctatctgcgcattatctgtcaccacaatggcattgtccaccagcatccccatggcgataataaatgccgccaaggaagtacggttcaatcctaccccccacatcaacataataagcaaagtaccacctaccgagaaaagtaacgaactacctatcagcataccggcacgcgatcccatcaccacaaagataatcaggataacaataaccaatgattctatcaaattcaggataaagccattattcgcctcatcggcaatcttgtcctcaggataaagcgaggtcagttcaatgccgataggcaacaattgctctatttccgccaacctttcgtccactgctttacccacagctaccacattatcctttgctccactggccacacctataccgatagcacgtttaccattgacccgcatcaaggttgaaggcggatcataatatccacgctccactgttgcaatatcccccaaacgggcttcccgtccgtccttgctgataatcaactggttttctatatcttccagactggtataagtcccttccgtacgcaagcgcaactgataaatttctgtcgctatatctcctgtattcacctgtatgttctgcttctgcaaaatgcccataatcgaagtgggatcaatacccaatgccgaaagtttggaggtagatatcttgacattgatcacttcggtctgctctccgtataacattactttctgtactccctcaatcggagtcaactgagtacggatacgctgtgcccagtcacgcaaatcggtatacgagaagccctcatcagctgtcaaagcataataaataccatacacatcaccaaagtcatcatttacagtaatggtagacgccccactgggcaacttgggttgtatattcgccactttacgacgtaattcgtcccattttacaggcatataatccggatcaatcgtaggctgaagttcaatagaaatcttagacagtccgaaataagattccgatttaatctgatatacatctgtcatggattgaatttcacgttcaatcggttccgtaatcagtttctccacttcatgtggattcgctcccggatactgggtaaccaataccgcagtctttatcacgaaaggcgcatcttctttcttaggcagcttgaagaaggagattactccgcctatcaacaaaatagccaaaaagaaatagataaccttccggttctccaaagaatattttggaatattcatgatatgctctctccttttttattctgttaatatttttacttgctggccatctaccagataagacgctccggcagacacaacctgttcgcccggttcaatatttccggatactatcaggtcgttacgtcctacaataattccctcatcactgactttacgcagttctactttctgtgtagacggattatatataaatacgatcttgctattcaagttattatcaaacactacagcggacaaaggcactgttattccttcttttaccacatcattctcaatattgacaataacacggcaagaaaagcccaccgataccttatattttttcaaatcaaattccggatcatcaatgtaaaggaatacaggaactcctgccccatcgggagaagcctctacatactcctttacttttgcctgaaataattttcctttataggcatcaaattctacgtaaatagtagaaggagaagttacataagaaatattcgtttcggggatagtgaactccacttgcaatttagccggattaatcaaacacaccactccttgtcctggctgtacacgctgatagttttcaacatattttttttggataaagccatcaaatggagcgcgtagcttggtgtcattcaatgtgttttgcgcattttcaaatgccgatttggcattggtatacgaagcttgggtcgtttcgaactcttgcatggaaatagcattcttggccaacagtttctctgcgcgttgcatctgtgatgacgccttttggaatgaagccctcttagcgtcataatccagtttgtaatctgtcggatcaatttcggccactacctgtcctttcttcacccgttgtccttcgagtacattcattgctaccagcggaccggacattttaaatgccaagtcactgaactgatcaggcgacacaacacctgaatacgatttttcgatcctgcttaacgaggtcacttccgccaatttcacgggacgaggaccgcgttcttgtgcaggttgctgtccgcaagaacagaacactgccgcaatcattgccataatagacaaatttttacctttcatactgtttatcttcactattagtttcgctgcaaagttcttataattattaaaagcgtacaagtgctaacagtaagatatattagtctatttttaagcattttctttgttatctgctctaactgccctatatttgtggtgcataatcaaaaccttctttatttttatgaagtatatagatgacattaacttatttaaatcgaataaggatttcgttgcagaaattgacatgacaggatcattaggccgtatttaccactacccgcaacgaatggaaggatgcttgttccttctgtgcctgcgaggtgaatgtgacataacgatccatctgtctgaacacaagatacaaaagaacgacattgtcactattctgccagaaacctttgtacatgttcaccggcaaagtcctgactgtcgtctgtacttgataggattcaacaaagagttgctgaacggaataaatctcttcaattccaccatgaactatctttcagccctgattgacacgcccattatccctctgcgtcccgaaataaccgagttgtttcaagactatttcctgttgctgataaaaatgaaacgtatgggagccaagcccaataaagacttaatcagcaccatgctgctcactatattgcacggtgtaggcagcattcatcagaacaccaatgtaaccacacgtactttcaaccgtggagaagaaattgtgaaacgcctggtccaatatatcatcaaacattatacgaaagaacggagcgtagctttttatgccgacctgcttcatatatcccctcagcatctcagtactacagtcaataagattacgggaaaaactgttacagatatcatcgccaaactagtgataacagatgcggaagccaaactaaaatccacagaccttaccattcaggaaatagcctattcacttaatttcccagacatctcgttctttggaaaatactttaaaagatatacaggaatgtcaccgaaacagtatagggaaaacggatagtgaaaacagactcagcccacgttagtatgtgtaaggtcagacgttagtacgtataagcctacacatactaacgtataagcttatacatactaacattccaaagtctcttacacctatataaaagttataagtttttcggcttataaatagcgttccaccaagtcgcatcatcctgcaaccatttggcaaaccaggcaaaaatcgtgttctgccactgaatcctcttgccataatccactatatgatgatcttgtcccgttacagccacaaaagccgtttcgcgccccagtaacttaagtgctgtaaacatctgaatgctctctcccaccggtacattcacatccgcatcaccgtgcaagaacagcaaaggcgtatgtatcttgtccgcattgaacaacgggctttgttttacaaaaagatcaggattgctccacggataactattcgccatggaaacttcactgtacgaatatccccaatatccttccccccaataactggtatgatcactgataccggcatgagagatggccgctgcaaaaatatcggtctgtgtttgcaggtattgtgtcatgaagccgccataggatgcacctatacagcctattttcttgtcattgacaaaagcatgttctttacaaaactgctttgtaccttctatgatatcctgtgccacccctgccccagctgtattgacgtggcgggcagaaaattcctgtccgaaaccggtagcaccgctaggttctatcacatacaccacatagcccaatgccgcgtatgcatgatgcggataacggctttcgaaattacggctgaccggactgcacccaccataataattcacaatcataggatatttccggttggcgtcaaaatgaggcggcaggtaataacgaccataaatggtatcaccacgagaattggtaaaactccaggccttgcattcgcccagctccacatctttcaatatgtctttacttaagtcttccaacaaagatgatttcatctttttggtattcatggtgtataaacggtcggaatttgaggcgctctgtccataataggccataaccggagcattttgcgccaatgagaatgagttgaccaaatcttctgaaacctccagttgctgaattttcccatcagcgggattcatccggtacaaactgtaacagtcacggttctcggccgtgaaatatatttgcccgtcggccttattccacacggcacgctgtacgctgggattaaaatctttcgtcagcggagtgactctcttatcagctatattcagcaaataaagctgaccgtccgtcatactcggagtctgcccctcctttacatttttccctattccacccagcgattcaggcgagccggataccaatacctgcgttccgtcaggtgaaaaacgggctccactgataaaaccatctttatctatcagcagttccgcctgtaaagtctgcatatccaaccgatatagtgagaataaagtagtaggacgcttggtcagacggctctgactggtcatcatcaaaagataccggccgtcattggaaatatcggcagcccagacattgtgataaccgaaagtcagtggctgcaacaaaccggtcttcaaatcatatttagccagataagaacggttacgccaccccggctggcggtcatccggttccagtacctcataaatttctttacgttctttcggaccttcctgggtcatggtgaaaagcaggtagtcttccgtaggtgcgaactggaaatacccgtcaggtaatttattcaccagcacagtttccattccggtaagcggatccacaactatcagctgcctgccatccactcccgtacgggtataataataacggttagaacgaggcatccattgcatattttcagtacgctccgccaaaaccttaccgctggcaagttcagtaatgcgcgtactaccggccgaccgaccacctacataagtcgtacgataattggtaatcaaatatctgccatcaggggaaagccctactccggcaaaacgagttccatgcaacacatccgccaaagtatatagctttttgttatcttgcttaagtgaaatgcttccctcttgatccgtatccacactcactttcaaggaatctgttttccctgcttcagaaagatatttaataactacagaatgggtggccggctccaaagcgagttcagtcccttcctgcttctttccatctacataaagctggtatcttttcaacccttcaatcttcagcttggctgtggcataacgagtattctccaacacaaaacccatcatgtgcaaggcatatcccgagtcacttcccggcaaaaccccgcctgtaaataaagttccctgttgcaatacgtccacagaaagatgagtatccaacagacgtccggatacaaaagtctttgaattcacatccacgctgtccacctgaaaaggggcctgtacaacgtagggtccggcataacggaaagtagtaatgtcaatcgtttcagcacctgccatcacagcccaggcaagtgcacaagacaataagatttgtttcttcatatttctaacaatttgtgttacacaaagatatgaaatataaaagaaacaaaaaccttttcctacgaatttcaatgcttcctacaacatattatttcacctctcccggcagatagcgtaactgcaaatactgttcccccggtttcagatatccgccttcgaatatttctttcctgatccggtaaacttccactcttttcaataagtaattttctaccttcatcggctgctttttacaccaggaaagcactttcagacttccatcggcatgaacatccgcataaacctttaccgttcttatcggagtcccgtccgttatcttacgtcctcttttataatccacccacaaaatagctttcgctttttccccctcacatgttccggcatactcatccgtttcggacgcggtggaaggtgaagaagttcccttacaacctacaaccacacataaaatcaaaagatataaaatatagcttcctcgtgttttcatatcaatcggattagtcttttatctcttctataggagtaatatcctctatttcaggcatccccggttctttcttctgacggaagcggatgatgtttatcaaatcggacagtccgtatacaatgctgctcactcccagaatgatgaatggaacagcagcagccgtaaatggattaaataataccacaatacctgcaatcagcaccaacacaggtatcacaaagaaacctcccggtaccaccgtccaactacgcgcagcagataaattcacaatctgactgattcccgccagtaccaaaacagcacccagcacatacatcaggataccgacaaaaaatgccggcataatcatcagccataatccgaacaaaaggctgccaagcccggcaataggaaaacgactgccatcctgcttgccacgaatcaaatacccggataaagaaaagagtcccggtactagaaacaacacaccgattgtaataaccagataaagaatggcagcctcaggccatgccaccagcaacacaccgatgaccaacgcacagatacatctgattatagaataattcattgttttcatattcaatcatgtctaattggttaatgaagcgaatatactgattatttctgagaagacagatgcaaaatggatattaattttcagacagaagaacaaaaaaagaaagccaaaacaaattttcctgccataagcttagaactaattctattgttctatagactttagcaaacagaatgttataccgactattccaatctattctttcgtacccatgcctgaagatcatccttttgtcttatgacaaatcactctatctgttctgtttcaggcagactttgttcattctcgtcctcatcgatcaaaatagcccaaaagagccaccataacagcaatcctgccaacaacacggcacctattcttatccaaagtttacgtttcatacacttcattttaatgatttattaactgatgtattaaaaccattccgccacccgaaatgttcatttataaaaccaatttaaagtaaacgcagaaagaaaaagcaaggttgatgataatacagcaaaaatgcagccctatcatcttcatatgccatcttattttttagagacatttactgaatatcccaaattaaaactccaactgttgcactttgattcaactatttcccaatttattcattgaataatatcctgtgcccctattttctcatattttgacttaggaactgttttaaatccgcttcagaaaaaaaatattcagtttcttaaatccttctgcgagacttacttttttactttcagctttttagccagctgctgatgggctttggctttggcgcgttggtagattttcagagctttgtcctgggctttctcatcggctgcattttttacgttatcatagagtgtccagagattggcagcagtagctacctctttctgggcgatggtatatgcttcggccttggcttcggtagcttcttcttcttctgccgaagcataggcgtgcttataccccttcatttcatcccaatgaccgcgggtaaaatcggggaaagtcacagctgcacagttgttatccatcgacagagcgcccaattccgagagacagcaccattcggctagatcatagacatccatatcaagcggcaaaccgttttgcaagcagtacaccaggcgagcatccatgatgtaatccatgccaccatgccccatggcacgccccttttcgccaaacttggtgaggatagggtgatagtatttcttttcaagggcctccttctgagcgtcattcagaaaactgtgggcattgatatcgtccatgttgggcgcagtatctttcatgacatcgcccgacaaggcatattcgggtgtggggtacttggtggcgtagcctttagttccggtcagcttaaacaggcggttgtatggttgcggtgtcatgacgttgtgttgaatttccactaccttgccacgagctgtgcgcatcagcgtagtagtgtggtcaccgttgcggaattcctttggttccttgccggtgaggttctcgacatattgcttacccacaaaactttcggtatccatagctaccaaggtagtgaagcggtctccgcggtgaatgtccatgcattgagccactggacccagaccatgggtggcatacacatcaccgcggttctccatattatacttcatgcgccaatgcaagttgtcggtatcgttgtcgttaggatcttgccagtacgacttccaaaaagccgacagttcgtggatgtaagcgccttcagcccgaatgatttcgccgaatactccgtccttagccatggccaaggcattcatctcataatagtcatagcagcagttctctaggatgaagcagtgcaggcgtgtctgttcagagagatcaatcaagctccagcattgctctaggttcatggccgatggcacttctatagccacgtgcttgccatgtttcatggcatacttagccacagggaagtggtgattccagtcagtggcaatatacaccagatcgatgtctggacgttgacaaagggtttcataccctttctcacctgaatagatatcggccggaatcaagctggcatcacgtaggtatttctgggatgcctctgcacggtcttcttcgtagtcgcatagtgccacgatttctacacctgggatgttgcagaagcgccacaccgcccaagggccgcgcatacctaagcccacaaaagccacacgcacggtttccatcttcggagcggtaagaccgagcacatgctgttggtcggtcggtcgctcaggggtttttattacaagggttcccttatcccaatggatttgggtagagggggacagtgattgcgcctgaaggccgctaatagacagcaacatcaagacagataacaaaagctttttcaatttcatactactattttttttaccaaataaacggttgagtgggcgaggctctgtaattgattcgtttgacctccctgccgcctgagcctcttttcagaagcgacaggaaggtcgtataatgaactgcaaacaaacgcttagcgggctgtcaacaggatgcgctgtccatcagcctgtacagcatacaccttggcactactttgatataccttagatggcactgtaaaggtgaaagagttggagaaatacagcaggcggctgtttgcttcgttttcacgcacctcaaaagccaccgcttcttcaccgtcactcacacggatagtagcaccttgatgtgaagaactgagagtgtaggtgggcaccttcgaaatcttggtatgattcttaaacacctcgtagtaacctacatcacctgactcttgcgcacgaggatcgctcgacgggaagaaatcacgcttccggtcttcgatgtactgaatgggtgccgccttcggatacttcttgttttgaatgtatgccttggtttcacatatcatttgttcggtcactgtatattgtgcttggccatactgctcaatgggggcatcaaccgccttgaagaatccccaggtttcaaagaactcggtaaggtcctcctgtgtggcatcacacactgctttgacaaaggccatctgcctctgtcccggctgatgggtaggcacatgctgatacgtggtgcgcatcagctcgaaaatcttcggccataccatgggtttcttgtcgtgtcctttacatagttcgtagtaaagccacaactgccaattcatgcgcatgtggatctccgtatcttcgccttggtgcgtagcactacccatgttataccaagcttgattctgtccatagacacattccgccaggtaatccaagccccggccacgtgatttgtatttgcccaactggtaaatgatgtagttagagaagagattgttgctcgactccgtagatcccatccagtcaatagccagctgatgcacatgacctatttcgtgagccggtccccaagcattgtcctcagctaacatcaccttatcatataagaggatgttgtccaaataggtatagacaaaagctattcggtaatcggatgcccacatatacgctccctccggcgagatagcaaagaggtggttattgaactggttagcatgcattttgtcaatacccatcaggctttgttcccactccacgatattatcccaaaggtggatggccgaaagaatctcggtgcgcacatgtttcagcatctccgagcgatggaagtagaaaatcatcttttcacctttcactccgaagtatttatcggtagctttggaaagcagttcagcgtacttctcattggtctgatgacgctgcagatcgaaatagccggtcacctgtccgctacctagcggaatatgaatacggatggaggtaggattcgactggaggtcagccgtatacatcacaaacagctggccgcggttgcggatggtgattttattcactccttctttgagaaaataaatatcgcctgaagctgctgtctgcacataattcttctcttcgccgaagcttgtggtttcctccccgatacactgcagcgcgacagggtagccgtgagtattgcccactaggacaataatttcatcgttcgcttcgaccgcgataccggtaagattatccagacaactgtagtgtttggtcatcagcctatcggcccacacgttgatgtcgctataagcctgataatcctggatacggaattctttctcccaggcatcgtaggtaccgtttttcaactgcgtggcaaggttgacaaagtagcccggcaactgattgatctgttctaaggtggcttctggcttcagttcactacaggtaatgtctgtaaataccgccagcagttgttgttcgagcttgttgtccggattcttttgaaaaaattccatctccgaacagctcacaaaattacctgctcccgattctacagcgaacttcactttggtgacttttttcactctctgactgaataccacgcggctggcgttgttctgcatttgaaaatcataattgccttgcaactgatactcgggcatttcgactgaagcagtgtaaatcttaagcttgccgaagttaccgttgccgctacgcgaatggtagaggatgtaatctaaatcccgggtaccatcgaactcatattccagtgtcaccgggaagtgggcttcctgtccccagggcgagtgataatgtttctcatcgaatttcccgtcgtaggtatgttcaatgccataacctggctgtaattcactggctacagccgaaataggggtcaacttcacatcaccttccacttctacatccgatgattccgacgctttctttttctgtgtcaaagtcaaggtttcctgtaacagactatcttcatacgcagtaaaggtcaaggttacggtacgagcttcgtacaagggattggcagcggcatgataaggataattcttcgatactagggcacgggtagccggcgcttccactgcctgcaaccagtcgccttcggccgacttctccaccgcatattctatgttggaagtgactgtaacaattacctcgccgccctcggcctcgagcgtagaaaccgaactcttgacgagcagagccggaccgtaacccaattgtttgacatgaatttcataattcttcaccagtgactttaccgtcaccacggcttcacgtatctcaggctcctcactcgccttcaccaaaatcttaatgctcggcttcgaagtagacaaatctttagccgcaatacaccaatcttggttagaagccacatcccaccgacttgcatcgagggtagtgctgaccggtatagatagctctcccttttccttggtaaaattctgttgtaaatctacttctgcaagagtgaatttttggatctgttcatccccggaattatcatcgctgcatccatagacgccaaatacatagaagggcaaaagcatcaataaaagggttggtaatattttcataaattagtgttatagaagtaagttaaaagaagagataatacgtagggtattttcttagatattatctcttcctaatataagatatattaagctgactgattaatttacatgcaacttcaattcggccagcgcgaaactgttacctgctggagtagattctaccaccaggcggatgtgcttgaactctttgcccaccagaatcggtgatttataggtgccttttgtagcagtggggaatccttccataatcgtcattattttactaaatgtgataccgtccatactgcctagcacactgatacgctgcggtgccccgttgttgttattgtgacgtacctggtattcaaacatcaaagccgtgtgtggttcatctaaattcaactgtatccagtgcggcaaccccggttcttccaaataatcggaatggtagtaggtatccggattaccgtcgaacatatagtcaatttttccttccacttcacggttaggatggatggctgtcatgtcacgtgacagagtgaccggatgcagtttcgattcatcaggcacataggagatgccgaagagacacgactgtttattaggattgatttcaaagtaaggcgagctacattgtgtcattttcaaaggtagcacatagttaccataactcaatttatttcgtttcacggtaacggttaagctagctgatttactgccagctgtaaacaaaatctttccttcgttgctcagcgtataagcttcttccgacagcatggtgtaatccactccgttcttttcattatactcggtcaacagactctcgtctggctccagtgtacagctaaaattccacttattgtctaccgaaaagaccgcaggcagattcagctcgatttcatttgcgtccatagcatctgaaatgatattcagattatatcctgttttctcaaatgcaacattaggtacaattacagcgggcttcagaaacacatatttacgctcggcattgatggaatccgcactattttgcaagataaatggaatcacaaaattcccctcttgctggttgctttctaggatcttatccgtaatcaatgtaacggatctggtctggtaagtatcgttaggaccgaattctatctgtttatctccattaaatacgtaacaatcttctgggtataattgatagtcttttccgttttgttcattgtagatttccagcaacgctttatccataacatcaatggaagctcgggtgactgtacccagttgagtgcctgatttgttgacaatcaactggtattctccgttttcacctgtattatatacttccacttcaatctcatcacagtttcggaaggatagaatggtgctgaattcatccaaaaactcatccttattatcatcgcaagcaatataggttaggcagcaggctgctgtcagggctatagttaataatttgtttttcatacaactgattttgttaaattatacataccgggggcattaccaaccataattttgtgtcaacaacttgttgcgatccagttctcgctgagagaaaggatagagataatgcttgttttggaagacacgggtttcaaaagccgttctctcccagaaaccgtcgggggtttcagttcccttcataccagcatcaagcggacaggaagtgttcataccatacatcttgccgttgtcagtttgagtagcaatcatccatgtacgggtatcgaaatagcgatggcgttcgaaagccaattctatctgacgttcttttctgcagagctgaatcaactcttctgtagaaacttgtccgtaggtacttgtgatggggtccaatcccgcgcgtttccgtaggtcggcccatttttccatggctagagcttcatagctgggatctagtgccaccccattcttcttgcactcgagcacggcttcaatgaaatttaggtagatttctcccaaacgaaataccgggaaagttatattaccccactgtccttcggacgaattgagtttatggtcatagaaacggttgcagaggtagccactctttggatagtcgtgactcttattaccgttaccgcctttcgcaaaagagatggaagtagcgctattgccgtgcagccactggtttccgccaaagaatacggtgacatagaagcggggttcccgatccttatacatattgggagcttcgatttcaaaatcagccttgttgctccaaccaccagacggatatatccaagatgatttctccagttcggaagccagttcatagccagataagggctctacgataggtgttccatctgcttcatatcctgtgataggataccaaccggtattcatggcatacgcatccaccaaagcttgagtagggcctactgccccataagccgtaccagccacgccggtgggcacagtacctattccccaggaaaacagtccgttataacggtcagtccaaatcagctctttattccaagtttcgtgtgtcactccataataatcttcatacgggttatcgttaccagctcggtaaagttcgtagcagggattgtcaatcagtttcttggctgcttcagcagctttctgccatttggtattatcgagctcagggaagagcttaacacctgacagttcagggaagtcgggtgcatcgggattcttcaccgtgctatagagtttattaccattgaacagcgggcgggccgaatatagcagtagtcgggagatcacggcatggcaagtacctaccgtagccaatccccacttcgccgccggcaaatcggactgttgaagaacaacgccactttcagcacactgcgtcatttcgctgaccacgtagttaacacattgatcccaggtattgcgcgggcgatacagttcttctgtgctggcggtgaaatccagcaaatcatcgcctaacagaaataccggaccatagtcacgcatcatcagaaaataatagtaagcacgggcaaaacgagtctgccagtaccattcgtccaattgatctttagtgactaacgggtcgctgcatttgtacacattttgcaggaaaatattacattcgcggatacctttataatagtggtccatcttataataaggaacctgtgaggggttccaggtaccaaagtttatccaacggtactgacggtcatacgcaatggtacattcgtccgatgctcctaaatacggttcagtatcaccctgcaagcttccattttcattgggcaaaaaagacatggcatttagccaatattgctgggtagtgtttctggatttccagattttatcaaaagtcagtttttcgtcttcttgtctatcaagaaaatcttcgcatgagcccaaggtaaaagctccaagtgctaagtatattatggatttgaagtaatttttatatttcatatttgatataatttaaaagttagcattgaatccgacagtaataacacgattcagcggatagcctgagccatctgatgagcctttggctttttcaggatcccataatttgaaagagctgaatgtaagtaaattgtttccggatacataaaatctcaacgatttaataaatgttttagtgacaaattctttaggtaaagtatatccgatttcaatgtttttcagacgtaaaaaggagccattgcgcaaccaccaggtggaattcttgttgttgttgaaagcgccggcacccccgctaccattgcttaggcgcggataggtgacatgagcattctgttcaggcgaattagtagacatccacactttgccccacaggtctttattgatagccgcacgttccatgttaccactggagaacggactctttaccgatacaccatctagaaagaaagaagtatgagcagaaccttggaagaaggcgttgatatcccagtttttccattgtgcacccaaaccgaaaccgtacatgatttccggcaggttggtataaccgatcgccacctcatcttgtgtatcgatgatgccgtcgccattgatatcctgatatttgatatctcctacacggtattcaccgaaagtctgacgcgggctgttgtcaatttcttcctgactttggaatagacctagggctacaagaccgaaaggctgcatctgaccgtcagaaccgaacggcttgcctatgcgattttggtatttgtattcccaatcgggttcgtcgttatcaagcagcttgttgcggctgaaagtaaagttaccgcgggcagttagaaatacttttccaatttggtgattgtactctacattggcatcaaatcccttgttgagtgttctacctatgttaacatacggaatggtggataaaccgacaatggctggcaaaccggcgcgttgcaggaaaatgccttgacgctcttcacggaagtagtcagcctgcacctttactttattgaacagagagaattccacacccaaattgagtttggtagcctcttcccaggaagcatacaaattttctacttcccctacgcggatacctgctcccccttgattaccgctttggccgaaccaccagccttgatcgccagtgcctacaattgtagattcataaacccaacgtctttgtccgccgatatcatcgttacctactttaccataagaacctttcagtttcaacatgtcaatggtcttggtgagcggttcaaaccatttttcgttcgataccatccatcccaaagcaaaagccgggaagaaaccgaagcgatgtccgcgggcaaagttttcagatccgttgtatcccatgttcacttcggcaaaataagtatctcgaaaagcatacgtcacacgaccagccaagccttggttcttataaggtaatgctgcattgccgtcggcagcctgggtgttggtatggattttctgattataaaggaaaagagctcccacgcgatggttaccaaataagcgattatagttcaacgaaccttccagataacgggtcatagtaccttggcgtccaatttcataacctaatgattcactgccggtgtgtacagggtcccattctccatcattgttgttgtcatcgtacgtcagtcgaccttccgcatcacgtccgcgtgcatggtagaagctgggtgatttggagcgacgttgcagcgtggtattccaagcatcccaagagaatttgatattagcagttagaccttccagcggttcccaaatcttaccgaagtcttgagtcaagccaatcaaagattgagccgaattccaaaattgttcacgataacctgagtgtaccagcatattccacggattgtggccggagtcggtagacggaccggacaaagtaccatcggaatactgtaccggaaatgcattcggagaagcattaaaggtatagctccaaatatcgttatcattatcgccgaagccaggaccgaatgacttttcatagatattggctaggttgacattcaacgtggtactcttagtcacattcaaatcgacattggcacggaaattgaacttgttataacggatggctgagttgtaaccatagatattaccagcgtttttatagatagaactttcattgtagaacgaaccggacacataatacttaatgttgtcaccaccaccagtcacactcaagttcacacgctggttctctgccatgtcatcaaacagggcatcaaaccaatccacatccggataaagatctggatcgctgtggtcgcgatatttctgaatcacttccggagagtagtagttggtaccactggcttcattgtaaagttctgcccattgtgccgagttaatcatttccggtcgtttggtgggagcagtaaagccgaattctgtgcggacattgatagccggttttccttcctgccctttcttggtagtaatcaaaataacaccatttgcgcccctaacaccatatacggctgaagcagaggcatctttcaaaatagaaaaggtagcaatgtcatctgtatccaccaaatccagatcacgctcaataccatcaactaacaccagcggcgtagaagtacccttgaatgatgaaacacctcggatatagaaatcggccgaactgtttttacccggttcacctgaacggctcatggctactacaccagaaagttgacctgctaatacattagaaatggaagcacccggtacattgagtttacgcatgtcaagtgtagaaattgctcctaccacactttctttcttctgactaccgtaccctacaactaccacttcatcaagcacttcggtgtcaggttccaacaccacattgattacttcctgattagcaagggcaatttcctgttttttgtaaccgatgtacgaaaactctaatacccccccaactccttcaataacgatggaatatttaccatccacatcggtaataaccccgatagaactgttcttaagccagatactggctccgatgatcggttctttgatgtcgctggcagttacaacaccgattatggtacgttttttaacttgctgcgtattttcagtcttagtcacttttaaaataacttcttttcctttaataacgtagcttacgttgctgccctcaaatacatcttttagaactttttcaatatttcccgtgctgttataatcgcgtttcgtgttgttttccaaatctgacgcattataaaagaacgtgtattcactgtttttttcaatcagctgaatagcctgtttaatggtcatgtcttctccttttacagaaatatatttctgtgctcccatactggacatgggataaagaagaaaaacaaggatgatacttaacagtatcgaaaaacgacaaaaagtgtgtttcttcattctgttttttttaaagtttaacattaggtttacttgttttaatgattgtttttataaataattatctcattaccatttgctttcatttcgagactaagactataacaaattttctgtaagacatctttcagtgattcttctaagcggatttttcctgtaaaggcagactgttgtttaaggttgattccttccaacttgatgttactgttatacctgctgttgattgtctcaatcaattgtttcaagggaagattcgtaaactgaaaactgccatttttgtatttaatatttctcaaccattcctttgttatattatccttcttaatataatatgttaatttttgaaatggttgcatttcaatggtttcatgattttccgctgtaaaatccactttcccgcaaaacaaaataatttcatttgtctgctggttttgattctggtgaatatcaaagctggttccttttacttctatcatgccctgattaatgtagacttgaaatggaaccccattctgacgcattacctcaaagaatgaattccccttcagccagacttttcggtccttgagaaatgccttggcatatcgcagactacttcctttctgcatccatactttcgaactgtctggcaatgtgtacagttgggattcctgtgcagtcacttcaataaagtcattcacacaaccggcttgttgtttggcaaaccacaatccagcagacgtgatcaacaagagggtcaccgttgcagctatcatttgccatttgggaaacatttgaaagaatcttcggtttttattatcttgtttatttttgatgtttctccaaatttgctctttcatttgccaatcaatggactcattgcccgcttcgtcccattgttttctaagctgaaaatctatctcatccaattggataaatatcttgcgttgctctttggacatcgtccctgagagcaatctttttatgaacgtttttctattatcaattttcatacctataaatatctttttacgtgcatctataataaatacacctgaaacccttttccccccacatcggatttgaaaaaaatatttttctgattagaattttataaatatctatatgtcattgcgcttataaaatcaaaaaagtagttgtttttaacaccacttgaaaaaaagaacgtaaacgtgcctttttaccgtttagtcaaataaaaggcttaagttttttttaattaatcattttttaattaattaatttttataactttgtggttatatttctaaataaatgaaagagaaagtgatactaaatagaatgaaggcaggtgatgaagaagcatttgcctggctgtataaccattattggcaaaaggtttatcattttgctcggctctatttgacctcttctaccgaaatctcagaagctgtgcaagacgtttttctgcatgtttgggaggcaagagaaacctttgacaacagcaagaattttgacggttatctctttattattacccgcaacatcatatttaattattcaaggcgttattttaatgaactcaattttaaaatgactgtattgcaaagcatggaagaaggttatagtatagaagaagaactggatgcacgggatttaaagaggtatattgataagctagtagtccaactacctgctaatcggcaacgtattttccgcatgagccgcgaactgcacctaagcaataagcagatagcagaacagtgtgccgtaacagaaaaagctgtggaacgtcagattaccttagccttgaaatttatccgagataatcttccgttctttgtgctcttcatgcgcttttaatctgagtcttctgttccctgtttctgccaatggtcggtgcgaaaaggagtcactagcagaccgaacctaggaaaaaggttattgtgagtagtacctgcccaattatagtgcatggctacgggatggagtacctcagaagattgcacccatacttcttttttacggactgtggcagtagctggataaaatatccggtcactgtctgctacgaaaaaccgctcagattctcatttgaagcgaatctctttcctatttccctacaacgaatccgaatagtatttcctccgatgatatgcttcacgtaaacaggcgattccaacaagcacttcctccgtatatctgcttcaagataacctgtgcaagacgaaatcccttatcaaaggctttttgctacgacatagcttagtgtaacgaaaagtcggcaattaccgctaggaccgtacgacttatggccagtgttgccgcctaagcttcgcacaggaaagtctatggagaattatcagcagactctgtagaaagctcataactgcccagttgtaccaaaagaaatggcagatcggctaagaaatgtgattattaatgatagtatagaaaagttatactatcaaaatgtattattataacatcttataataatgtgcctcgtctggtagaaaaagattctgttatttatttgcataaggagtttaaagatgtttttatcaataaaatctctaaaagttcttccaatccgatttttactccttttcgtctgcaatgagaatagccttgccacactctcatttagagtaatggcagggctatttcatatttatctattataatccttcactttctcggatattcggttttgttccattctctttattgtttctattcccaatgagatgtgaattggaaagttatcttatatccagtgcctgttatctccttgccatcaaattcaccgaaatcaagagtctgcttgcctgacggagatttgatgtttgagagtatcatagcattgtctattataatgtcaaaagactgcggagtggcacttttttcccgtgtatccccatcctgatttattgtttcccattctgaatacgcatacataaccttttggttctgctctatccgcacaggatagctcacttcatccatattgtccatgtcgtttttggtctgtccatatatcctgcatattataccggaacaatctgtggatgacacggtcaaatattcataacttttaccactgttcgtacttgaagttgagctgtaaaatctatccaaattaatcgtgatacttcttatggattgcttgaaactggctgtaatagtactgttggaaccatgcagggtggcggtagtggttgaactgcctggattttcgatagttacatcaccacctataattgtccagcctgtaaattcatacccactctccggagtagccgtaatactgatcggcttttccacctgatattcccttgttcctttcggattagttgttccgccttcacctgcattgatcgtcagtgtgcgttttttttccttgaatccacaatggaaagtatggtcctgaccgcctaagtcaacatcgaactctgaagtcccggattgtgcataatcgtatttcttaggttgattagccggccctccataaaaatagttcacctcatatcctgcatcaggatgggcttcaacaggaacatttttgcgtccgtcatacagtcctgctccagtggcataccccccggtaaaatcaacccttccgtctgaagagcgggctgaggtttccagcatcccctcgccttcgatgatgatacgtgtatcaccggtagggaccgattcgtccttttcagaatcctgttccattatctcctcattctggcagcctgtgaacatggccacgaacgccgccaacagtaaaaatttaacttgtttcatacttcattcttttttaaaggtttattataattgtatgtatcatttctttttcttatcgtccagcacgtcggcatcgatgcgggcctcgaacgtcgcataaagcacgaaccggttgaaaaaataataagtattgcgtgtcttgctgaaccttatgtcagcccccatcagccggagttcctccaggtagttgctgacggtccgttcactcacccgcatcctgccggccagttccgcacggctgccggtactttccgtccggatcagcctgtacatccggttgatccgttctatgtagctgacaacggaaaggctcgtcatatcctctcctccagtccggtctgttccaggaatctgcggaaatacccctcctccaggtacaggcatctcatcaacgcctcctttccctccctggcatacacccggcgaaggagcgggaaatccgtggaataaatgttccatctgatcagcccctccgccctccggtcaagttccgggcagtcagttccttccatccgatacctcacggagaggaagtacaggttcttcagcctgtatttctcaagaaaggaaatatccttcgggcatgccttcagcccgtcggcggcgatgcaccttaatacaagctgttcaatctcttcctgaattgtcatatccataccagtatggttttatagttctaccgttctttcttatctcataatgcagatgatagcctgtgcttctgcccgtgctcccgacaaagccgataacagcccctttcccgagctttttgccctccgtcgtatagtaagctgccagatgtgcgtaaagcgtttcaaagccgtaggaatgccgtatgatgacgcatcttccatagcctcccttccttcctgcgaaaacgaccgtaccggaagcggtggcatggaccggtgcggccagctccactgccatatcgattcccgaatgaaaactatgttttcccgttatgggatgaatcctgcctccatacgggctgcttatcctgaacttgtctttcaggggacatgacagagggagcctgtctgccaccccgtaccggtaaagtatgtccctgcaagcttccaggctttccagacggctgcatttttccagtgccgtatcgagcagttcccttccgttttccccctcgaaagaaaaggggaagaacaatatgagcatcagcagtttcatctggatatcctccttaatatcctgtccgcttcatcttccgttttctgctcctgcaggcttctgaacacttcctccgctcccagaagtgacttgtttttaagtttgtacagaaagtgccggccgccgtttctctcctggatctcgatgatgagccttttcttgtcaggaatggtaaacttgttcatggccactgtgaacgtccggctctcatgtgcaggtatctcctccgggtagtcgaaagcgaacaggatgttctgctcgatctgctgcaccgccgtcttcttgcggatctttgcatcctggatatagaaccgcatgaaatccgtcgtatagcctatctgtgtgcggtttgtcagcgtcattcgcagcagcaggatgtccccgtcgatgaagatgtttccgacctcgaactccatgccggcattcttgtccttcagtcccaggtccaggggaatcctcttcgagattgcctgcctgatcctttccttctgttcgcttgaccgttccctctcgtcaaggatggccaccctttgcgtcttttccttgtcaatgacaaagctgaaacgttccgggaaaggggcataatggagattgaaagtgtagaatttccccccttcgaccactgccgagatgttcgtgtcttccgtaaactctccggtggctttcactgccaggatgttgtccactccctcggccttttcaacctccacatttgtactgccatagtccacataggtgattccggccgggaaaatgaggaacatctgcctgtcctttcccaccggcagtgtatggggcgcgggtgcctggccgtccacacgcacatagctctccaccgggtgggcgttatagctgatggcataggagtagaacttcgtgtcggctgtcaccaccgacagggtagtctcacccgggaaattctcctcggccgctttcaggcgtatgatctccgggcagttcccgactttctcaccgatgacatagtcaccgccgatactgtaatacttcacctcggtagggaatatcaggtgcagggtcttctcgtacccgatctgaaggggcactgccggaagctcctcgatcctctgggctttccctgaaaggaaaacggacaggaacagtcctgttatgtaaattctgttcggtttcatggttttctttcaattttatatctttgtatgcaaactttaaaatttaaattatgatggatttcttttctaaattcttaactcctttattcaaagtgcaaaaagccgtttcttttggcatcatataaaaaatgcttcaccatcttgttatttattgtctcttcctacgttggtcgcttccgtctttcagattgcatgctgcgatacattcacgctgccatcattcaagctgacttttatatggacggtaatgacaatctatacaactgttttcatactgggatttggatatagaaaagaaactgattctcagaataaaaataatgacacaattaatactgatacagacaaagaaaaaacgtagatatatctcatgcctgcttttgattatttgtttcttgacatttatcaggttcttttctgatacctttttctttttttcttgaatattcacggtaactcttccaaaaccctaaaatgtggaaaacaatattaagggtgagaagaaagcagaaaagtaagatggtcacagagccgtttttcgataagaattcttccatatcatacatttttttcatcattcgttattgtcactttcagagtccgtttataatggcttacaggcacttcacttcctgattagcggatgccttttcccctttaaatactttttaatttttcgcatggccttctttacaaaagtcccgatactgagaatgaaattttccagtttccctgagaacaggagtaggatatatccattcaggcagataaccagaagggcagaaagtgcatagtaccagaatttttccatgtcatacaactgcatgattattcatttcatcaaactccttcaggaagcgtgccgcaaccgttgggaatatcccgtcaaagagattgtacatcagttccggtctctgcggccgccgatatactatcactttctttccggcccccttcatccatcccgcttctgccagcggatgctccagcgcgtccaggtactcatctgtttccattttctcccagttcccgctgatctgcgaccagcagaagtccgtttttctttcagggttcctgaagtcatacacctcatgcccccgttctcttaaaaaagccacgatccgtggctggtattcgttgctccagctgcttgccacatatacttttgccatagttttcctccttttacttatcgtttttcataactttctcataacctcccggattttttcatcctgcggagaagtccttccccggaaaaggaaacagaccatgtctcttcattttgtcactctttcaaatcccgtttcaaattgtcggtaaaagctgtctgagtccgtaacttgttgttaatggccgttttgccatattacctgttctctttctgcttgtttgaggagtctgtatctttattcagtccttttctgacagccgggagattccagcccacaatgacaagcgctatcatatatatccatacttgcggaagccttattgcttccgcaataaattcttttatctgttccattttttccagtattttttttgattcgttccataactttacatattgtttccgttacttttctttcctcattctttttgcatccttcagcagtatccggtagttcgtcttgatggtcacctttatcttgcggatattcttgcttgcggccgacttggtcgcgttgatgacgctgttcgccgcgcccgccactatctggcttcccatgtcaagtcccccggaaatgcttgtgttcgttccgctgacacccgcggcttccgcctccttgatggtttccgccttggcatttcccggaacgtatatgccttccatggcatcctcggaatacacctccttttcaaagggaagtatgttcccggccagattcaccgaggtgattttgaccagcacccgttccccgtcgattccggtcacctccccgaacaccggtgttcccttgcggatgcgctgtccgtcgtccgtaaggcagttctccgccagctgcatcttcagcgtcgctccgaccatgaccgtctgtgtggaatgtacgaatgcccgtatgacgttcctctcgtcctgccggacaaggcgcacgctgttgaatcctctccggggagtctcttcgggaaccgtgtcctccggttccgtcttccccggtttctcctcctcaccgtccgtcgtctccttctccctgaaggcggagggggcgggctgttccgttccggaaagcggaccgcttccgagggtctgttcgttgcgtctgatcagttcccggatgcgctgtatctcgctttccggggaaacggtgtcctcgggttcatccattccgtaattccctccaccgggcatgcggttttctctccggttctccatttccttttccacactcccgagcatgtccttgagcgtgaagttgtccttgatttcagagcgcagcctcacttcttcctccctgccgtcctcttttttcggtaatgtggcgatgatcccccataccagcaggatgatcacggctcctataccccccagcgccactattctgctcctttcagtttttgtcatggcatctcgtattgctggttgtatgtctggaagaaaaatccggaagtgttctccggaaaacgtggcgtggtacgtatgacggtgccctcgctgagaatccgtatcttcctgacatcatttccgttgatgatgctcaggactgacgagaaggtgacgtgatactcgtccccgctgacggataccgagagcatcttctcgaactccgtcctgtagaccactccgagttccagggcgtcgccgtaccccctgtcagcctggtatttggcgaatatggtgttcgcgtccggcttgttgaccaggaacagggcgcgtgcccggttctcctgcagggagagcctatcgaaactgttcagataataggccgtatggtagcagtggttctttaaaagggattcatacagcatgtcctgccgtaccgccttgaaatgcacgaactcgcccccttcgttgacaaccagtatcttgttcatcgcgccgttcaccaccctgtaggcgaacagcaggaccatcgcgattgtcaccgcgctgaatatgaacaccagtttcgtacggaatgtatggttccttctggcttccgccagcccggaaaaatccctgagtatgttttttatattgagtatgttctttttctccatcataatgttataaccatttgttaactgttgcttttaccgtcgcgagcattgtcagtttcaggatgaacgagaagatcaccatgagcaccacggaccagggcctctgctgtacgtaattgaccactatcaggtccgagaacacgctggcgatgacaaatcccggatacagcatgtagcacccgaccatctgtctggcccatgtgtagaaggagctgcgggtgtcgctgttgtacaggcaggctatcgccaggggcgatatgacctcgagcagtatcaggatgaggtagcgcgtgcacaggaacaccagcatgaggtagtcgtatgcgactcccccgaaactgcccaccgcccccgccagcagggagtcgaaggccgtgtccagcccgttgaccgctatgtcgatgatgtcactgttcatcaggtcgtcgaagagctgctcgatcggcttcttccagatattgtccggattgtagacccctccggcggcgagcgactccatcagcctgtccgcggcgtatgcaagtacggtctcaagcgtgtccagcaacacgggcatgatgcagatgagggctatgcagaggatgtactccctgcccagctcataaaactgttttgcattgaatcccttgccttcgtgaaccatctccttgatgatacccgcaagcttgaatacaaaggtggtaatcacaaatccggcaacaagggcatagaatccctccaccactatcatccccttgatctgcaggtatgcgttgttcagattgctgtatgcctcttccatgtctatctcaggtttctcttcagcctttcatactgggatatgatccgggataccttcgagaccttcctttcctgctcgatggtctgtctctctatctcctgcaggacggccagccgttcggagtcgttcatcttcacgcttgtggagagtatggtccttgacaggctgatgagccgtgtgttgttgagcatgaccaggtcaaggctggatgtgagcgtctgcagggttgacgtgcccagctttttgttcgtcaccaggtctatgcacttctctgacagccttccctgtctctctatgattgatttggcggtctcacagctggagatgacggagttgaccttgcgcatcatgtccagtgtctcgtccagccggtctttctgctccttcaggtagcccacctgtttctgcagttccgagaagttcttgacgttctgtgcaaggttgggcgcgtccgccaccgcccattgtgcggatgcggttgccgccgtcatcagcacgagcatggataaaagtagtttcttcatttgttcttgtttttgttgtttcttatttcttattgatgttcccttatatattcctctatggcgtcctccatggacatcctccggttcttctcctcaaggtccgaccatatctccccctccgtctggaacgcaaggaatttctcccttgagaactccaggcgggtgacggtggcgtaatgttcccccagccgcatgaaacactccgaatagggccgttgtcccgaaaaattgttcctcatggacttcatcagggctatctggccgggatgggtcagcctgaacctgtctatgacggactggtagatgacctccttggtggggagcacgaacagcatgtccgtattggctatgatgttctttgtgtgctcgttctccggcagctggtcgggattctggatgatggtgtataccgccccgttctccttcctgatcttctgatagcagaaggccacggagctgtgtatcccggttcccgtggccgtatcgaccatctgcgcggtctcgccgtactcgtcaaagatcaggacgccccgtttcctccggtcactgagcagcttcttctgtatgacggtgaatatcatgcccatcacgaggttgctcagaaacctgtcctgcttgatctgcgtcagttcgaacacgatgaacttctttcccgagaagtccgtccccgtatccttgcacacgttctcgtagcgtctgccgggcaggaactcgccgcagttcaggctgaaggactccagggagaaataatctttggggatgtgcttcctttccagaatctcggggtaatgttccgtcacgtggttgtagaaactctcgaaattgtgcccttcacggacattctcgtaatagtcctggatgaaacgggtgagggccacctccttctccgactcgtcctttgtgaacatgtgcctccagtatttctgcacgactcccgagagcatctcgatgcttccgttgtccagttcctccccctgcaggtcgaaggggttgatgcccagcgccgtccttccgtcgtagtccacgtgcagggagatgtccggatagagcctgcagagctggctgaagctctttccgaactcgaccaccacgaccgtatagtcctgctcgatgagctgctgggtgaggttcagggtaaaggcggacttgccgccgccggttccggctatgaccatcccgttacgggcgttgaccctcttcttgcccgcatcccagatgtcctttctcagagggacctggtacatcctgtcatgcacatagatgccctcgctgtcattcctgaaactgccgcactggagaaagaagcacaatgccatgggcagggtggtcaggaacaggtatttccgcggcatcaggtggatctggccggggacgcaggcgaaatgcaccgccgccaggttctcatatccggggatataataccggaggcgggccaggttgagcgtctccctgatctttttgtcggccttctccagtttggcctccgactcgtcgaacacacagaccgagaagaagctgcgtaccagtgtctcgttctcctcaaggatttcctgctggagctcgtccagcttctggtactgtaccttgatggacctgctcatgccggaattgcttccataaatgtcgatattgcgggcgatccgctcgcgcagccgtccgttcccctcaaagaaaaccacctggttcacgatgtggttgtacggcaggtacatcccaagctgctccagcatcggatggtacagcagggagccggcgggaggaagggagtcgtcccgtacacaggaatccaggctgccgtcagggagaaaggtctcatcgcagacggcgaagcagcgtgcccgtttctttcctgtgcggagttccgtgtcggcatgtatgtccacaaccgcccccggagcgtcgaacagggtggtgtatccggccgtgaagtcccgcatttcctgccctgacatcggggctgtctccgtatcacgcatgctccggatgatgccgacggcgttgtcaactccctcgaggaattcatcgagcctggcaaggtcctccttatggaggttctccttataggacaggggcgaggatatgtaggccttctcaagacttttgagcccggaaagtacaaagtgcatgacgcaggtatggctgacatacagtcgtccccggaaatgccgcgcatcggcccggtcaaggaaagagccgccggcaatgtccggacagtacctttccttgaggaacacatcctgtttgtgcacatatgtgccgtccgggagaaacttgaaggcttcccggaacatgccgtccctcctgtcgatatcctccggagtcagggaatagcattccggttcccggagttcgaaagaaacgcatatgctgccgctgcgggtcaggacgacgccctgtccctccgattcactgacaatgtcaagtatgctgtatgcctcttctgatttcattatgctccttttttgttaataccctgtttatgtccagattactgatgtttatctcttttcccgtgtccttgaatttttggggtcgtgcctttcttttcagcttgtatagaagcagcggcagggtgggcagcgagatgacgagcaccaggaccggcaggttccagttgcctgcggatatccccgcacggatgccgaggaagaacaggacgaaagcggccgaacagcagccgacgaatatccagtagtccccggaaagaagcccccgtatcatgcaggggctctccagtccttttctgatcctgtatctcatatcgacaggctgatgccggaaatggcactctttacggcggacaccacgactgcggccagcaatgcaaagccgacataccagcccagtgcgacgaatccttcctttcgcgtgcccctgttttccttgtcgatgatattgtcccattgctggataagacccagaatgatacctccaagcataaaaccgccgaacacgggcagtgtaaaactgtccaggacatcattgatcgctccccgggcgtcctgggcgaatccccggagtgtatatgatgcagacatgacagtcagaaacaatttttttcctgtaaaatttctcattttgttattattcgttaggtttgatggttccggtatagtcttctccttcctgccagggacggacacttacaccggagagaatgagtcccccttctttgctcagggacaatgcatatccgtatctttttccggcctccagggtgacggccggcagcagccagccgtatgtgttctcctgaaaacggatcatgaccctgttgtttcccgccttgcccggcagcagaaggagggtgttcccatccgaggggaccgttcctttttcccctgccgagagtttgccgccggcaaggtcataagtgccgcctgtaggaaccccctccacactcagagtgcacgcgctgctgccctctatggtgaattccagcaggcagagcaggtgttccatcgctatgtccgccgaccggttctgccagtccaggcgtatctccccggatgccaggtagtcggtctgggggaccaggctcaggggcagctcctttcccgggatggcggcgaaaggggagaatgcgaacagcctgcagggggtctccgtgagtgtgacctccggaaagatccagccctccccgtatgtcacatgcagcgggtttacggctccggcataaccgccgcccgtatcgtcaagcagcaccattccgaaatctttcacaagggcgggacttccgtcagttccgccacggctggagcagttctctatcctcagtccggccttcccgccctgcgggaagggctcccgttcacccgagcagcccgcaaggactgccggtagcaggaacaggacaaccggtttgtatatgtctattttcataaccacattcaattgattttttgttattgttcgatgtcaatggaagtctttcccggctgtacaattttcaatgacagcgttttgccgctttcatcctgtttgagggtcacaagaccggtcctcctttcctttgccggattctcgtcatagcttaccgatgagccgttcacatgaatccagctgtcaccggatgcgctccaggaaagggcttttgtagagttgcccgtcttcttgtaacttgttatgtccagaatgaatgagccggccgatgagtcgtccggatattcggtatggccggttccgccatccgcatagctgaaataatagcttaccggagatccttcctgggtgattgtggccgtggccgagcttcctccgtgacttgccgtaaacacacagctccgggatgagcctgacgggttttccgacactgtcaccgtattccctgaaaggaggaatccttctgctcctccgctgagggaggggacagccgtctgtgtgttttctgccactccgttgacgaacactccgcgtgaggctcccgccataagggaagatctgccgccctgccagccgatgacggagggatttgccgtcagggtgaccgaccagccgccataattacggtacctgggttcgagtgtacggtccgacagtacctcgaaactgtaccgtgtgtcattcgacacgatcctgccgtcctcgtaccatcctgcgaactcataaccgccgttcacggacgcggtgaccgtgcaggtgcttcccatgtcgtacaggcccgcacctgtggtgcttccaccctgcggatagtcaaggacggttatccgtatcttgtaatctatccggtagttgtggattctgccgggttcggtggtcatgtcggaagtgccgcgcagcttcatgtccggggttcctgtgagggttatgtaattggaggttgtcgtaagggtctgggcgggtatggtcatccggaataccgtggtgaggttcccggaactgtacctgtacatggcatagcttcccctggtctcgtccgtaacggtttttccggtaagcaggttgaaccggctgccgtatttcacattttccatacgggcgccgtccacgcggtcgcttccttccacccggacctccacggtcgacagccggtgctcgaaatgcagcggtatcgtatagtcctgtattacgtccgtataggacgctgtcaggaaatcggctgaaagccatccggacttttcctgctggtctcctatggaatgggatatggcggtgatgtctgtctgcccctccttgaaaggataatatacatagaagtcaagatcggtccccaccgtcacaatgatgttgtcctcttccgttgcgggtttgaatgcccggccgtcataggtgtatttgttatttgtggcccagtacacgccggtcttgggctcgatggcaaatacgcctatggagtttcccttttcgaacgtgccttcctgggtggcacgcgtttgggcgacggtaaaggtgacacggccgttttccgggcatggctcctcctgttccttccggcaggaggatacggacagcaggacaaggaagccgcagattatcgttgttattgattttaccatgattgtttttttaggacggggaccggagtcccctgttgttctgtaatttatttgaccggtacaagcgttacgtcggattcgcttgaaccccatggctcgatggttacggactgtccgttctcgcctccgatttccgcgtcattggagcgcatcgttatcgaatagatatatctctttccggcttcccagcttatctggggaatggaataggtataggttgccccgtcgatgacgacctccatgctgacttctccggatgccaggctcatgggatagattgcggcggcgaagtctaccgacgggttcccctgtgccggaatggtcgtgttgggagtccatgagagttccgtggatgtcggggagaagatgatccttccgttgtcgttcaggttcattgtccccgaggttccgaacttggccgccttggatttcagtttcgcggatgtcaggttgccgtcattatgatattccggagaaactttcagacggatgacgagctgggacaatgcatgtttcatgggaatgacggcatccgtttcaatgaccgacacctggtttgtgctctttccccacatgtagtcgacagaggttcccgcattgatgggaacggggactttggtaccgtcagcgacggcctggttgtatgggtaatacgcccatatcgtcgccttgtccgaaagaagatagacgggttttgcctggctccatccggccgctgtttttgtggacttgttgttctgcgcgtcataacgcggataggcgtccccccatccggtggccttgtacatgaacagccccatggcgtcatttaccgcccattcggttttcggcacgaagccggccctcgtgtccgtgccgactgtcggcacaatattcagtacggaggctgaaactccgtctgtttccggttgttcgtccactatttccttgttgctgcatgaagccagcatcccggcggcaattaccgctgccgaaatcataattcttgttttcatttttcttgttgatttggttttgttataattatagtcttatggaaattccgtttcgggggtgtcctcccagtccgggatgatgaccggcccgccaatctccagttccctgccgatgtgcaggtccagctccagcgaaatctcgtcaccgtcgaatccccgcagatacggggtcaggtcaactgactgccgttcattgaatacggagtcctcctccttcatcagaacctctacggcaagaatgttctctgccgccggactgaatccgaacacataaaggcccgccgtccatacattgtcggccttctttgcgaaggaggcggtcgcacttgcggttccggtcctttcacgggaggccagatacctggccgtagagattcccgaaagggtacagttcaagccggacaacggtacggtgttgccggacacgttaatctttatgttcagtttctggacaaaagccgcaggctgtatccttacccgtttgggattccggtattcaagcctttcactgaaggccgaggaacagcagaatttctgtacctctgaaatgtgcgcctccccgtcaatggtgtcagtccggacggacagacgcgtctcatgatagtcattcctgtccagcagttcatagttccccgtatagaacaggaacctgtatgccccctggggcaggctccagcggagtgtatcctgtgtgaacgttgtcccttcggaatacggcacatccgttccgaaagggatgacgtgtctttcctgggggacaggcggcttttcctttattccgctgaaatcgcaccaggctacaagttctccttcccggatgcagaagtcctcattgaaattgcagccgccgagcattattgcggggaatgacgcaagtaccagtacttttctgtcaatattcatctttgtataaattataagtttcaataagcgtgtttatttcggggtccagccgtccgcgccatatcttgccggcatcctggtcgcatgacctgacatatgacttgacggcatcctccttgcgccccaggcggctgtacaggatggcgagcaggtagttccggtctgatgtgtcccgctgttcccgcatgatctcaagcgcacgggcgtcatagccgagcgacatgaggcagacagcggtattatagtctgccgggtagtgctcgtccagcagggcaagagcctgtttgtacctcctgtcctctatcatccgcacggcagccatataggtgctgtcgatgaccggcatcacaaccgtgtcctgaatcatgtcccgccggtggagatggaacaggaattccactccgcgcaggagaggataatgcttttcccggattctcctgtaatcctccggatattttctcagggcgtgctcacggatgtccggattccttgtttcctccatgatccggagcagttccggccggtgtctcagggtgtcgtcttttgcgacaagtccgcgcagcctttcccagtcttccccccgccatgcagggcggaagatggtgtcaacgccttccgcatcctccgtacgtcttgcaaggtactttttcagttccgtcgcacgtcccctggacaggaacagattcatccccgcatcaccctccggagatgaggtcgcggtcatcagcacgctgtctatgaggaactctcctgtatagtttatgctccgtatcgccttgaacaccttgtcgatttccgacctgttgtttccggtttcctcccggaactcggtactgcctgtcttataggccacgtatgcgcgcaggcttacctcgtccttgcgggtgacaattttctttttatagcggggagtccggtcaaggaactgcaccatgctcgatatgaaataggtgatcgtgtccgacggcggaagcggggtacgtgtctcgtccttggaaaggatcagtccgtcaagcgtcagatctatccttttcgtgttttccgtggccgggagctcctgcttgtagtaatagacgaacttgttcccttcccggatgaccgtatccagacgggccggctcatacggaaaacgcacatatttgtcatacatggcaccggcctgttcctttctcttctggttctccgccatcttgccgtaatcggtgaaacgcctcgtgatggcggcggaatcttcaggggagatgctccgggtacggatcttatatccgccttcggcaaacatcctccatctggaagggatatatttcccttcaagctccctggtcatccagtaggcgggaagatgctccaggattgaattgtagccggcgatggctctccggttctgctcgacacgccagttgaacagggcaaaccgggcattggccttgtccgaccagtcaatccagcgttctttctgcagcacctcgtgcttccaggcctggaagtattcctcttccagttcggccagtgccttcctgtagcctttcccgtcgaacagtttctgcaggtacaggctgtcgggtatgatggagttgatgaacgcctggtagcgcatatagcctcttttctgcatcttggcaaagtcagcccctgaaaggaagatcctgtccagatataacgtatccgaaggcttgtaggccaccggggccagctggagttgccacttgttgctgaccaattctcccggaaccgtcacgacaaaatccaggtttatcttcccgttgcgttcagccacctgcttgcttctggccataacggtaatttcggacagttccacggaagtgatctcctcaccggtcacgctgtctttctcggcccgcgtgacgatatgccgctcacccttgtcgtccgtccatgctatctgttccggcaccttgcaggccgtatccgttgtcgcctccctcaccccgggctgcgagatgcgcacgcgtgccagacggtgctccgatccgcaggaaaggagcaggcccgagagcagtgcaaacggtatgatacgtcttgtagtcctcatccttcccgcttaaaaaagatacacgacattgagagctgcacgggtcggaagaaaatgccagccgtactcctgtccgacaaggtccccgcagcgtttgcacagatatttgtcataagccagccatacggcacccgcaccggcttcccattcaaggttccagcgcctgcctatctggtaggccttcccgatacttaaacctactccgtagccttccccctcgtagcggtacttgttgccgaacaggttccccacgctgtaggtgccggccgtaccgtacatgccgatgaatccgcccatgtagctttccagcagccagtagcgtactccgggggccgcatagaaattgcggaactgccggttgcggccgaacttgaacgggttgtactgcacgggcaggtgcagtgaccatttacggttcagcgtcatggaagcctccagattcaggttggtcgttgccagaccgatcacattggtacgcaatgagtaggactgtgccgataccgacaggaagaatgccagcagtcccgcacacagaaacagcttttttcccgtattcattctcatgcctcctttgctttgatgacggtcacctcccaggccgtcagggtattgaaccaccggttctcccactggcgggcggaacagtcaaatttcacatgtacagtctggccggcttcaaccgcataccggtcgatgttggcgttcatcagctgcaggcacaggctctgcggtctgctttcctccgtctcgaggacaaactcccggctcttccactcgttgccggaagttttgccgaccccatcctttatgggaagtacggcgataacttttccttgtatttccatatttaatcggttttatttaacagaatgtcacaataggcatctgcatctattttttgagattgtattttattgattttgaatccggctgcgaaaaaatcagaaagttcgatgcctgataagaaaaaagtccttatctcaatatattctccgggcattgttaaacctgacatctccttttgttgccaatatctaacccatgtatgagcgttcttattgagaaggttgaatataatttgttctatactcattctttttttcgttatacgttaatttctaatttccccctatatttgttatatgggctttctacataaaattcccactcaccagtaaatcgtagccgaaagacttgttttgcaagctcaatgacatcttctattgtttcaaaacagttagtcaaatcaccttcatcgtagtaatctccccatcgttccgggtctttgtctatttcttccttagtaagcggacgtttaagcacaagctcataggtataatgtgccaatgggatattgttgtcaaatatcattttactatgtcccggttctccgtcacattccatattgacaccttgaatctttatctttccgtaatgatgtacagcgttgaaagaaatgcctctgaacgtcgtaatttcaagcgtagcgcgccttttgggattacctttggtgtacccccaagaccttacggcatgaagtttatcattagaaagtataatatcaagaccgcatttatctgtaaacacatcgggataaacatattgttccccttggctttgttttactatctgctctaatgtcatatttcctcctttctattctcgttttgagtattaatttttttcaatgaaagtattggttgtattcaacactccggctgaatcttgacttttgccatctcttatgaagattccttcttctttcagcctttcataatcgattttattcataagaataacactcgcattgccatctatatacagtttgcattgcatgaattgagttccttttacttcctcaattacgtctatttgcattgttctttttttactcatatctaattcgttattagttaatcctcaatggcatacaatgcctgcatacactcaaaggggaaagatgaatttaaagcgtcatatatttcttccggtatatcatcttcgctttcaaaattaccttcaacactttcagatccaaatgctgttgcaacatgcttctctttatactccttaccattaatggttacggttgtttcccatccgtcagaggttacttcgattactatcttattcattactaaattgtttatagtcatatccagctatttccgttgaaaatcaaaaatggctttctgtaactcttcactatctttgggtatatgtgtttcatcaatatgacaatagcaatatttgctgccgtaactgcacacgttgaatgtattgttcagagtttcgccatattcccaccgtgcattcggattcggtatcctaccttcctggagccactgccattctgttttcatgttctctcgataagccatgtttttttttcgcttttcgtcccttttatctgatgcttttttgtgttctttttgtttagctctaagcatgtcctttgcagtttcagagtctttgtgaacttcgttgtctttgtagtatgttgctttctgcccgtgaaaacaattagtccaacgttcttcgcctaccgcatcagcgttaggtacatgaccctcttttacccattgtaatgccgttaatgcttccataggtcttattgtattaaatccaatttaatagcttcaactttcttaatacatctaccatcagggggagttattgtgaatcctccatatcctttgactgattcctgccggtatgcctccgcagaagatggaggcagcgcttgacaagacgcagccgccgggtttccacgcagggaagcacctccagggtcaccaccaccggcacgtcctgccaggtgattcgcggaaacatctccccgaactgtcctttgggaatgtaaagggcttcctcgccggtccacatccccgtgtccctttcgggaggacaggcgaaaagatgtcccgtaccgttatagtccacggcaaaccagtatgtgtttctcattctttctctccgtccttgtctttcccgggaaaggaaactgtgccttttcccagcaggttcctcacttttgcaatggagatgatgcatacaagattgtccggctttcctttcacatggatgtaccatcttccggaatcgtttcccgcatcgaaatgcaggggttgggtacgcagatacctggcatccagttcttctatccggcaatgaatctcctctttcagatcatccagtgcgttccgatccttgagcaggcagtccttgaacttcaggatatggctctggagctcgctgcctttcctattgaccgacgcataagtctgtatataatgtataaagtacatactattatgattttaacggtttattctatttcctcgccccataaatccagatcactgggggcggtcctgatctgatacgcaagccacagcatgcccagtgcatacagggtcgcaaatgatatccacaatactgtcatataccacctccttttatctgccggttcagactgatgttcctgccgtcacccatgcctgagtaatacgcggagcggtcggttccggtctttctcggatgtgcctttgaagtgccggttcctattttttccaggtacttgtcaataagcgcgtcatggcagcatgttagggcggtttcccgtgcctcaccttcggaagtggtggactccttcagacgcatcagcttgcgtatacgttccatgattttatccggtatgtcattgttcagtttcatgcttgatcgtttaatcctcatcaaaatcatccttctgtaaatcgtagccggtcagtacggcttctttcaacaacgttttcaggtcatctgacaggccggatgacagcagtcttccggcaatctcttccgcacgttcctcaaggcttttcttttcctccgtgcagaaagtgaccgtaccgaaccgggtggtgtatttcctgccttctatagttatgtcctgggagaagttcacgcgggcggcattgcacctgacagattccctggccagacgctttccgagccatccggcaaaggccatgaggcccgtatgggaaccggcggccctgtccatgcaacgctcaaggttctggctcatgccctcctcgaacatgaccctcgcaaacgttctcccggcattgcagccgttccggactgccgcatcccggtatatttcctcaaatgttttcatcgttctgtttttttgctcttcatatttcatgtcccgctgccggacacccggtcttctgcaggaattcgttaaaatcattgcacctggggtacaggcgttccgactcgttcaccagtatcacgtcttcaggaaggaagctccgtatctttcccagtgccccgcgtcccggggcgtcgttgtcgagaaaggcgtgcaccttctcatactttgaaaggaaatcctttgaacggtccacaatggccgtggagttcaatacgcacacgtccagctttccaagtgcgggcatctccggatgctcccttgcgtactgcttgaaactgagaaggtcaaaaaagccctcgaaaacggcgcaggacctgttgccttcactgatgcaggtaatatccttggcgtaggcgcaccccttgaacatgctgttccgcaattcgaaaccccggtggtcgttggcgaatccgagcgcgtatttctcacgcggattcctctcgaaacagtagtggacctccacacagtatttacggacaatctccccgtcaatgccacgtgaggcggcgtagtcaagcagatgcctgttctgaacgggaatgaccttcaggacggtcatcggggcggctgccggaagccttcctgacaccgtttccggtttccgtatcgaaggcatggaaagctgcggggaggtcctcatccttccgagttccttcatggcctgcggaaaggagcagttttccacacgcatgaccagatccaccgccctgccatacgtaccgtccccaaaatcataccagcggttctcctccctgaaaaccttgaagctcggggaagtatcggaacggaagggggaacggtacatgtcatagccgccgtaccgtctggacggctcgtaaccgtaatgggagaggatgtctcccaacgggattgaattggcttcctgtgatgtcatggttatgtcgctttaatggtattttccgtttgattcctgccggtcctcacggatgggcaggatgagttctttaaatttataaatttattcccgccatcctcgcggacagcttttcagggtaattccatcatattgtcaacacggcagtttccggcttctatgcggaaactgcctgcctcatacggctcaggataaacctggtggggctcttgatcctcttgttcccccaggtctccttcaaggcggtgtccagcaccatgggcgccacggaggcgagctgcaggatctcctgctggtcccttaccgcgacccccagaagctcgagcgtcttgcggcggttgcgcatggtttcctcctgcctcctctgccggtcggcctctccgtactcggcgttgtatttggcgatatagttttcaacgagaggatataggtagttccccttggtcaggtggaaatcactctgcaggatatcctcgatcgcctttccgaccgggaattcgggataacaggccgaaagccggtatatccagccggtataatactcgtccactcccagatacttgagctttcccgaaagagaatccctgtcctcatccttctccccttcaccggaggcttgtgccggaggggttggggaggatattttattttcttttattttatacggtttattttcgcgagttttgtccgcttcttcgcgaagttccttttcagcggcgaacaatgtgcgtatgcgagtcacagcctgccggatttccttcccatcctccggaagggaggccggagatccgcattcatgtgccggggtgtcctgctgttcacaagtggcatgcggtatggtggcggactccggtgacggttccgtttccagcagaaggatgctttccggaatgccgggcttgcggtggatggccttgcagatgcctacatacagttcctgtatctcctcactggtcagaatctgtttgtcctgccacagttctttgttgaaaaggcccagttcggcgcagtagtcgatgatgtccgaaacctttttctcatccatacgggaatagtccgagatgtcgaacagaccgtcggcatccataaccatatagcatccctcgacacggtagatctcgtttacaatgaaatggaacacaccccagccttccattccaaatttattttttagtctctttactttcggatcatagaaatgatcggtttcgaacctgaaataggtgaaaccctttttagctgtttttggcataagctttatatttaaagtggataatacatcagctggccgaaagctcgaactccttgggaatgtcgggatatcgggagagcagaccgcaggatctgacatgatccatatagttccgctgtatgtcagcggaagtcaggatgcggtgtttttcgtatagctcaccgttgaaaagtccgacttgtatgcagccgttgacaattcttgtgacatcttccaaagaggcattccagtaagaggccaccgcctgcgccgtttcctcgcaccacagcaggaggtagctcccgttgtggagtgtctcgtttacgagataccggtaaatgctgtaaccggaaaaaccgtattggcgggtgagtcttctgactttcatgtcagaaaattgggaagtgctgagctcatagcaaggatgtgttccgcattcctggcgccgtacagcccgtgacaggcggcggcttgttccgtttgtaaagctttgggtattcatatatgataatgtataatgtttactgttaagaattatgtatatgacggaccgggctcccactccttgggagaatgggaccggtgattatctggccggaggaatatggtgcttcttccggacgaactggacataattgtggacggtcttctcgcagacgtgcggaaagtccggataatgttcccgcaagtagtcgccgatgcggctgctggaaatggagggaaaactggtaaggagggatgcgacggcctgctcgtaggcatggagtttgtaatgccgttctttgtgctggaggacttcctccaagcttagggattgaagatgtcgtaccgtattacgggacacaccaagacgacgggctgtccgcgcaatgttgattccccgtgaacgaagatcaaggatattgctccataatatgtatttttctgttaaatttgccgcatccataatctattagacagatttcgtaactgggacattccagattacgaatctttgatgcagctaaattaccgccctcaggaagatgcgctagaagtactgaaaagctcagcgctgatgcagcagatacctgacaaagagttcattttaaaacttttacaagcctataaaggatgcagaaaaataaatgaagacaacaaagactattataaatacaaacaggaccatataactcgctatttatctcaccaaaccagcaataatattcataaaaattataacagtatttatgaagtatgggcagccagactacaagaatatgatatcaaacaactgatcctcactatgccaaatacttttaatgaaaatccttttaccactcctcaaaaagttataaaagaaacgattgaattaataaatcaaacatattaaaaagaaaaagcccggctctcacgaaccgggctttttcagcatcattatactttaaagtatttacagattttattcagcaactacttcgaacgggatctctacagaaacttccttgtgaagtttaacgatagctttgtaagaaccaacttctttcactgcatctttcacaacgataatctttctgtcaaccttgtgacccaatttttccaattcctcagcaatttgaatgttgctaacagaaccgaaaatagtacctgtggcactcactttagtagcaatagtcaaggttacatccttcaactgttctgccatagcttcagcatctttcttaatcttttccaatttgtgagcgcgttgtttcagctcttctgccaacattttcttagctgaaggtgaagcaatcactgccttaccagtcggaataagatagttacgaccgtaaccagacttcacagttacaatatcatttttgtagcctaagttcactacgtcttctttcaaaattatttccatacttattcctccttattatttcatcatgtcagttacaaatggaagtaacgccaagtgacgtgctcttttaacagcctgcgcaatacgacgttggaacttcagagaagtacctgtaatacggcgaggaaggattttaccctgttcgttcaagaatttcttcaagaattcaggatctttgtaatcaatgtacttaataccactttttttgaaacggcagtattttttcttctttacgtctactgagggcggagttaaatatctgatttctgattgttgctgtgccatgattaatcctcctttttagttgatttaacatttcttctcttagcagcatattcagcagcgtatttatccattttaaaagtcaagaaacggataacacggtcgtcacgacggaagttaatttccaacttttcaataacctgcggttctgctttgaactctatcaactgatagaaaccagttgatttcttttggatggggtaagccagctttttcaagccccagttttcctcattgataatctctgcaccttctgcagtcagaatacctttgaatttctctaccgcttccttcatctgaacatcagataaaacgggagttaaaatgaaaacggtttcgtattgattcatactacgtttattaaattattaaattaaatttcaaatgcgagtgcaaaagtagatattttatcttaatctacaaagagttatcgcaattttcttcaaaaaatatagtttcattttacaattaattttccttttcatattttttatctgtgaaaaacaagttatatccgccaagaattgtatatttgcaaagttgtttaaacaataattccatgatagaacaatttagttttgatatccaattaatatttgccatattaaatggcaaagtatctgccgccatcaaccggaaactaagccggaattttcgccagaatggtgtagaaattacccccgaacagtggacagtccttctttttctatgggaaaaagatggtgtcacacagcaagaactatgtaatgccacttttaaagacaaacccagcatgacccgcttgatagacaatatggaacgccagcatttggtggtacgcatagccgacaaaagagatcgacgcaccaatttaattcatttgaccaaaaccggcagagaattggaaggcaaagcacgtttcatcgcaaacaagacattgaaagaagcactgcaaggattaacattggaagaactgaaagtcagccaagatgtattaagaaaggtattcaccaacatcaaagactaaagtttttcaaggttttcatctttttttcctaaaataatttccatgataagagaattatgctttaatttgtacacaagaataaatataatctattaataaaatacacacatgaaaagcttacttaagaatttaggtctgatactgatgatcatcggcgccgctattttagtcggtgttttcttcaccggaagtgcagcaattaacgacaacggtgttttaggtggaagtgccgcccttatcgttataggtttaatcgtttatattgtattaaacaaacgcattgttgattaaagtataagagaacaaaaataaaaaagtccgaaacaaatgttccggacttttttatttcatctatttcactcagccttattctacttcgggagtaatcagtttataccccttcccgtgaatgttgataatctcgatagaatcatcttctttcaaatgtttacgcaacttagtgatgtacacgtccatgcttcgtgcattgaaataattatcatcaatccaaatggttttcaatgcgaaatcacgctgcagaatctcattagcatgagcacaaagcaagcccaataattcggattctttcgtagtcagtttagtctgttttccatcgatagccaaaatttgtttctgagtatcgaaagtaaaacgaccaatcttgtaaatattgctttccttgtttctcttaccacgtacacgacgcaaaatagcctcgatacggaaagtcaactcttccatactgaacggtttagtgatatagtcatccgcaccaatcttgaagccttccaatatatcctctttcaaagttttagcagtcaggaagataataggaatttcagcgttagcctgacggatttcctgtgctaaagtaaaaccgtctttcttcggcatcatcacatccaatacacataagtcgtatttgttcttaaggaaagccttgtagccagcctcaccatccgggcaaagttcggccgagtagccttttgcctgcaaatattctctcaatagcatgccaagattctcatcatcttcgcataacaagatacgcaatttctcgtccatattattcattttttaataaaggtaatacaattataaatttagttcctacattcaattcactctcggcacgtatagcccctttgtgatcttgaattatttttttcacataagccagtcccaaaccaaagcctttcacatcgtgtaggttaccggtatgcacacgatagaatttatcgaatatcttcttcaggttttctttcttaatacctattccattgtcctggatagagatataaagcttgcccgattcattccaagtacgtacattcaacaacaattcgccttcctgttttttatatttcactgcattgtccagcaaattaaaaataacatttgtaaaatgcatctcgtctacaaatatatccggatttaccgcatccagattcgaagtgattttaccattgtatttctctaccttcaacgtgaaagtattgacaacaccggctatcaaatcatttgcattcacctctttcatcttcagcgtcgctttttgcttttcgaacatagacatctgcaacaccttttccacttggaaacgcaaacgtttggtctcatcatttatcactccggatatatgctggaacatagcaggagattttcccactgccggatctttcaacatctgggccgccaacgatatggtagagataggcgtcttgaattcatgtgtcatattgtttatgaaatcattctttatctcggtcaacttcttctgacggaagatgatatagatagtaaagatgaacgtcacaagcaatacgaatgtgaagatcagtgacgggatcataaatttaacagaactgaatatgtaactgttcaatgtaggaaaatgaatatttactgtcgccatacgagccggaggatcatttttaaataaaacctgcggatatgtattctcactaccctctttggtataatcagggcaatggtaaacttccgtcccgtcacggtctgtcaccgtaaaatgataaggaatgtcaatgccattattcagcaattccgtctttaaaaacaagtccaactgtttaaagttgattcttttgttcaaaggtttgtcactagctgtatacaaaatgttatagaccacttcgtccaacaatgcacgttggtacacatatctgtctttgattatttcctgcaaggctcttgaagtctgaggaatgttcttaccagtcgaaataattgctttaggaatattagaaggacgattcgcactgaacctcatcttcaattcaaaagtagagtaaccgttcaatccgtcggaagtaatggaatactcatgcgtatgcgccaccacatcaccacttccttcccccttcttctcttcggactgctccctggacagctgtgctgctttttccgtagcaatcgcatcatcctcaagatactttttagtttccaccaactcaatattccgacacgcctggaccaagctgcgctgaacagactcatcaaattgccctttgcgcattttcaccatttcttcaatatagcttacctgcaaatacaacaagctaagaaatgatagccccattacaatacctaatacccaaatagtagactttttcatgccagcaaaattaaaagcgttaaatctcatcacacaatagattaaccaaatttaaacggccattctctataattaaccgaaaaagtcatttaagctaagattctgactattataacaaaatttacgccaattggtttgcaaaaataataaaaaattaagttcaaagccaaataacaaacctaaaagtttaagttaccttaaataaaaagagacgcatttttaacgaaatacgtctcttctaagtacgaaattttacactttatcaatcatctttattctctttagcttcaaattccttcatcaatttttcttgtacgtctgtcggaaccaattcatagctggcaaacttcataataaatgaagcgcgaccgcctgtcaaagaacttaaagaagtggaataagaagacatttctttcagaggtacttttgcaaccagtttttcgtatccactttcactgctcatccccataatcataccacgacgaccttgcaaatcactcatcacatcgcccattttatcgctgggaacgaaaacctccacatcataaatcggctccagaatcttaggtccggcattcttaaatgcctcactgaatgcattacgtcctgcaagcataaaagagatttcatttgagtctaccggatgcatcttaccatcataaacaatcactcgtacatcacgcgcatacgaacctgtcaacggaccctgctccatccggctcataatccctttcaagatagcaggcataaaacgggcatcaatagatcctcccacgatactgttaataaagactaatttaccaccccattccaaaggtatttcctcagtccccttcacatttatcttgaattcctgaccgttaaacttatacgtttcgggtacaggcattccttcataataaggttcaacaatgagatggacctcaccaaattgcccagcaccgcctgattgtttcttatgacgataatcggcacgggctgctttagtgattgtttcacgataagggatcttaggctcctcgaacttaatctgcaatttttcgttattttccaaacgccacttcaaggtacggagatgaaactcaccttgtccatgcacaatagtctgtttcaattccttagattgctccacttcccaagtaggatcttcctcacgcatacggttcaatataaccatcatcttctctacatcagcctcatttacaggcttgatggcacgcgagtatttagcattaggatatttaatgaagttaaaccggttttcacagtctttgccgttcaaggtatttccagtctttacatctttcaatttcacagtacaaccaatatctccggctaccagttcctgcaccggaatacgattagctcccgcacaaacaaaaagctgtgccatacgctctttagagccacgatcagcattagtcaaatcgtcaccttcgtgtacttttccgctcatcactttaaaatactgcacaccaccgatatggggttcaacggcagtcttgaagaaataaagagaagtagggccattcgcatcgggaggcacaggaacaccacgggtattatgaaccacaggcatatccgacacgaatggaacaacattacctaagaattccatcagacgacggacacccatatccttacctgcacatacacagaaaacagggaacataccacgtgccgccaatcccttacggataccttcacgcatttcatcttcagtcaatgattccgattcaaagaacttttccatcagtgtctcatcattttcagcagcagcctctaccaaagctttatgcatctccaatgccttttctttctcagaatcaggaatctcttcaattgtaggagcgcccccttcaggtccccatgaatatttcttcatcaacagcacgtcaatgagttcatgaaaattaggtcccgtttcaagaggatactgcacgggaactaccttggagccataaatgctacgcaactgttcgagcacattgtcatagtcacatttctcattatcaagctgattgaccaaaaagataaccggcttgcccagcttttcagtataacggaagtggttctgagtacctacttcgggaccgtattgtccattcagcagcaaaatagcagtatcggttacatttagcgcggttatggcagcccctacgaagtcatcactacccggacagtcaattatatttagtttttttccattccattctacatgataaacggtagagaacactgaataaccatattcttgctctaccggaaaataatcactaaccgtgtttttggcagtaattctgccacgacgttttataataccactctcaaagagcaaagactctgtgagggtggttttacctgagccatcattgccaagaagtgcaatgtttttaatttcgttagtctgatatactttcatgatatctaaggtttaattattaacaaacggatatgtgtttcatatctcctaaaaatgtggagcgcaaattagaaaataaagagaaaaaaagcaactcaaaggatagtgttactaaactatgttttacggcagatattctatcttatcactatttttttcgtagctttgctgaaaaataaatgatcatggcaggtatttatctacatatccccttttgcaaaaaacgttgtatttactgcgattttttctccaccacccgtagcgaacagaaaacagcatacatccgtgccttatgccgcgaactaaccgaccgggaagcctatctggaaggcgagcatatagaaacgatatatctgggcggcggcactccctcgcaactggcaaaagaagatttcgaagcaatcttctcccatatttataaggtatacaaagtaatccccgatgctgaaatcactttggaagctaatcccgatgacttaacgccagaatacatttccatgttacgcacctttccttttaaccggataagtatgggaattcaaacttttcaagactccactttaaaactgcttcaacgccgccacacagccgaacaagccatccgtgctttccaaaactgtcgtactgccggtttccggaatattagtattgacttgatgtacggactacccggagaaacacttgcttcgtggaaagaagatttaaaacaagccctcgctttgcatccggaacatatttccgcttatcaccttatttatgaagaaggaaccactctttggcaacttcgtgaacaacataaactggaagaggccgatgaagatctgagcgtttccttattcggcacactgattgacagcctcaccgctgccggatacgaacattatgaaatatccaatttctgcctacccggttttcattcccggcacaactccagttattggactgaaaagaaatatttgggctgtggtccttccgcacattcatacaatggtacttcacgccaatggaatgtagcctcactaaacgaatatataagaggtatttctaacggaaatcccacattcgaagtagaagaacttgacttatatacccgttacaatgattttgtcattacccacatacgtacacaatggggaatgccactgcccaaactcaggaaacaatatggagaagaactgtacaaatactgcctacgtatggccactccacatttacaacaaggaacactggaaataaaaaacgatacgctaaaactgacccgtaaaggcgtttttatatcagacgggatcatgagcgacatgctttgggtggagtaactaatacttcagcgaatattcacatatgctattttaaaagcatcccccaaaaataaatgaataattttataaaatacgatagggagattttcaagtttccctgtctttacttatataaaccaataaactaaaaagatatgaaaacaagtacgcgcatagttcttccattcttccatgcattaatggaagcttatgcttacaatagcgaaaacgattctgaagaacacaggaaaacggaacaaaagagttccgaatgcaaccataacacaaatcaaattttggaaactctttctccgaatattacaaggaggataacagaccctgaataaaggcatataaattattgaataataaaagaaaactaaaaactaaatgattttttcaacttgcaatcaatacagtatcaaggggattttcttgatactgttactaatgatttccactacattcatacaggctcaaaaagcagatctttctttcagcattcacttaaaaaaagcgaatctgaaagaattcatatttgaaatagaaaaagcctccggctactcttttatttatggagaggaaatcatctttaaacatcctataaccctcagtctaagaaaagctccattaagcctgattttacagaaagcctttgcaggacagaatatcagtttcaaaataaacaaaaatcacattatattaaaaaaatacgctctacaatccagcaagaagtcttttaccctaaacgggtatgtattggacagtatatcgaaagaaacattgataggtgccaatatttatgatcagaaaaacggagtgggtaccactaccaatcctttcggatactttagcatcacattgcctgaggggggcactaaactaaacttttcatacataggctatgcagtaaaacaagtgtctttgcacctatggaaagatactatgctgaccatccaactccacaatgacaaccaactgaatgaggtcattatcttgtccgacaaacccgaaacgggtattcaaagcagtcgtatgggagcaagcagtattcctattccccacataaaaaacacaccggcattgatgagtgaggcagacgtactaaaatccatccaactactgcccggtgtacaaaacggaatgaacggaaccagtgggttatatgtacgcggaggaggtccggaccaaaatctttatttattagacggtgtacctttatataatgtagatcatacactgggcctgttatcggtcttcactccggaagccgtgaaaaaagtcgatttatacaaaagtagctttccggcacgattcggcggacgtctttcatctattgtcgatgtccgtaccaatgacggaaacatgcagcactatcatggaagcttgactatcggtcttctcacttcacatctgcaatttgaaggacctatatggaaagatcatacttccttcattatctcagcacgacgcagttatattgactgtttcctcccactagttatgccaaaggacgaacggggcggttatagtttgtatgacatcaacgccaagctaaatcatcgctttagtgaacaagatcgccttttcatctctttctataaaggaaaagaccacgtctactataaatacaaagatgaagataagttcaagcaaactcacaattggggaaacatattactgaacacacgctggaatcatgttttcaccccccaactattcagtaatactacgctggcatacaatcgttatgtttttgatatcagacaagaggaaacttccagcatacaacaacctgatggttccacaatcatcaatggttccaacaatctgtttcactccggcatcagtgatcttagcattagtacggattttgattatcatccgttaccggcacacaacatcaaatttggagcgaaatacatatatcatcagttcgctccggaagtgcagaccgtaaatcaacacaattccgacaatggatatccacaaactaacgacaattatagtttgaacaattctcatatccatgctcatgacttttccttgtatgccgaagatgatcttattctgaacgaacattggaaaataaatgccggattgcacttttcattttttaatgtacaaaaacagacttatctttctttgcaatcccgtctttccataagtttccaagcgacctcaaatatcatcttaaaaagttctttttcacagatgagccagtgtacccaattattatctactgcatcactggccatgccttccgacctttgggtgcccgtcacacgccacatccgccccatgaaatcttttcaatatgctgtaggagtatactataccggtatcaagaattgggaattttccatagaaggatactataaagatatgtataatgtattagaatataaagacggagaaagttttctaggttcttcccataactgggaagacaaagtagaaatgggcaaaggacgttcattcggagtggagtttatggcacaaaaaactgcagggctccttactggatggattaattacaccctatccaaatccgaccggcaattcagtacggacgggatcaataatggtaaacatttcccttaccaatatgaccgccgacataccttgaatctcactctaaattatcaattgacacgacggatcgacttcaatatgtcatggacttatgcatcaggttgcatggcaacacttcctacagagaagacacatacagaactaccacctaccaatgtaccaccttcctggattatggataatttgaacaaaggagatatggatcattatagttcacgaaataactacagattgcctgcaagccaccaattgaatataggattcaacttccataaacagacccggcacggagaacggatatggaatatcagtatcctaaatgcctacaatgccatgaaccccaactttgtctatatcagcagggaagcacaaacaggaaagcctatattgaaaaaaatgacaatcttgccatgtatcccttcattttcatacacttataaattttaaaatccaatgaaaaaataccttttatttctttgtgtatttgttattttaggcgcatgtaccaataccattggctatttacccgatgatgaacctaaaaaactgatcgtaaatgccatgatgcaaactgaaaataacgataaccggatttatctgcattacacaggatggacagctaccactcctgtcaccgatggtatcatacacctgtatatcaatggaaaactgtcagaaacaatcactgcggaagatgattactacccagtaaaaagcatattccgaacaggagataaagtgaaaatagaggcttcttcagaaaatggtaaatataaagcaaaagcggaaacacgcatcagtgcacccttacagattataaatgtagatacaacctatataagtttaagagattataacagctgggtaggaggcaagcctgtatatgacaattatcttcggcttaacattcaattaaaacaacccgatatagaggcagagaatacatactatcgtcttgaaataaaacagattttttattctcataaatggcatgacggcagggacactctcagtattgacacgacttataactataattatatttatgacaccgccttgacagacggcaaacccggacatgctatagatgaaggattcgagcttattcagaaatggaacaattattttggcctttttaaaagctgttattttaaaaacagggaatataacatgacgatagatttaaaagaagacatcaactatatacatatagattctcagaaagcagagcgatatatcagtatccggttttacagtatttcagaaagcgaacatagatatttgtatgccatgtcctctgcattagattttgatgccgaaaattttatttatgcagttccccttattcccaataatataaaaggaggaataggtatattcagtattgccaaccaagtaaaatacaaattgaaagaagaaaattgccaagacagatactaagaagaaggcttcagttcctctcatacaataaatcaaaactaaaagttctaaaatgaatagcacatctatttacattttagtagctttgcatccgattataacattaacaaacatgcccaacacggcaatggaggcaactgaactactcaaagaaatacagaagcatgattcccaacaggctttccggtctttatacgatatgtattatgaccgtttctttcgtatcgccttttattaccttcaacgggatgaatgggctcaagaagtaattttagatgtttttaccacgctttggaatcatcgaaaaagtcagcttattcccgatgattttaataagtacagctatatattaataagaaatgccgctctgaactatttggaaaaagaacaaaggagggaagcctcgcctctggaaaatatgccggaaatatcttcttccaacctttctcctgaagaacaaatgatgaatgaagagttatttaacatttatgagaactcactgaatgaattacctgaacgttgccgaacaatctttattaaagtccgcgaagaaaaacaaagttatgcttccgttgccgaagaacttaatataagccctaaaacagtagatgcccagttacaaaaagctgtaacccgactcaaagaaaaaattaacaattattttagaaatagacgatagggagttttccagattctcctgtctttatcaatagaaactaataaactaaaaagacatgagaacaaatacacgtttagtattaccatttttttatgccctgcttataagtgcatgtagtaacaacgacaactatcccaaagagtatataggctttgaaaaacaattcatatcacacacctatgatacaaagaacgaggaagaaacccttactttaaaaataatagctgccgaaaaacaagacacagaccgtaaactgaccattagcagttctacaagtaacaatagcttccacattcaaaatgcccatccggtcatcttgaaaggaaagaaatcagtaaaaatagatatcattctttatcctaaacaaataaaaagcgtacaacgtatcatacggttgatctgtactcctgacggaaaagacgcaaaaatttctgaaatttctatccgtctgcaaaagaagtagtatctttgtcctgcaaataaaataacatgaattcaccgaaatcagacaaagaactggacgaatggttggaattattatcttcttccactcattcaccgcagggaaaattctcggcggagaaaagttataatatattgcaacaacgtcttcaaccggcataccgcaagcacaaaatactttccattcggtatacagttgctgtggctgccggtttcgtcctgcttataggtttcggttggatgttttatttttaccaacgtccggtacgtacactgattgtttccaccaatatacaaactcaatgcatccaattaccggatggctctaaagtaaccctaaaccgacattcccaattgagctatccggaaactttcaacaaggaacgaatcgtaaagctgaatggagaagcttattttgaagtcagtaaaaatcctaaaaaaccatttcgtgtcaaagcaaatggagttaccatcagggtattaggcacgcattttaatgtcaatgcctatgccgccgattctttagtagaaacaaccctgctggaaggtagtgtatccgtcagtaacaatgccaacggtaaacaaatgatattaaagcccaatgaaacagccatttatcgtaaatcgactggaatattgtctatgcacattaatgcaaatgcacagaacgaaataagttggcgtgaaggtgttctttcttttaatgacatatctatgggagaaatcgctcgtcaactatcccatcattttaatgtcaccatacagataaaaagcgaacagttacgtaattataaattaaatgcacgtttcaagcaaaacgaaacgttggaagaaattctagaaatgttggctcccatcgtaggttttacttatcacatgccccaatccaatcttattgaactaaagcaagaaaactaaaaaacaaatgatttcttcactttataagaaacacagtatcacttttttttacttaatgctgttactagtcttttcccattcattcatatcagcacaaactccggatatgccttttaatatttatctgaaacaggctagtttaaaggagtttacagctaaaatagaacaactgtcagagtattcttttatttatggcgaagaagttgtactcaaacatcccataactctcgatctgaaagaaaccccattaacaactattctacaaacagctttcattaaacaagacatcagtttcgagattaccaaacaccatatcatattgaaaaaaacaacgtcacttcctataaaacaacattttacactaaacggttatgtattggacgaaatatcgaaagaaacactgataggtgccaatatctatgaccagcaaaataaacaaggaacaatcacaaatccattcggattcttcagtatcacactgcccgaaggaaacactgaactgaatttttcctatataggttacggttcaaaacaaatagcattgtatttatgtaaagatacgctgctgactgtccaacttaaaaacgataatacattggaagaaatcgttgtcctttctgataaaatggaaacaggctttcaaagtagccgtatgggagcaaacaatatacctttgacacatattaaaaatacccctgctttactgagtgaggcagatgtattaaaatcaatccagcttctgcccggtatacaaggaggtataaccggtaccagtggcctgtatgtacgtggaggaagtcccgatcagaatctttatctgctagacggtgtacccttatataatgtggaccatacactaggtattctctccatctttaccccagaatcggtcaagaaagtcgatttgtataaaagcagttttcctgcccgttacggaggaagactgtcctccgtcattgatgtacgcactaacgatggagatatgaggaattatcacggcagtctgaccatcgggctgctgacttctcgaatgcactttgagggtcctctatggaaagaccggacatcatttattatttctgccagacgcagttatgccgatttaattatcaagcctttcatggataaagatacgaaaggaggttactacttatatgatatcaacacaaaactaaatcatcgattcagtgaccgtgaccgcctgtttttctccttttatcatggcaaagatcatgccagttttacaaatacttcttcttattactttgaagaagaaaaggagacagacacaagagagagacaagtcatggcttggggaagtacattaggggcattacgttggaaccacatagtcagtaatcgtctgttccataacatcaccctatcctataaccgtttccgattcaatataaaaaacaatttcacgtccgccaacaaacaccttgacagccaatattattccggtatagaagattggggattaacatctgacttcgactttcatccatccccctcccatttcatcaaattcggaggaaactatctctaccatacgttccgccccgaaacccaacatacatttgtgcactctccgaatgaacaagaacaacctgataaaacatacaccatcggaggaaatgaagcgacacactcacacgaaatttccctttatgtagaagatgatttcaaatggaacgaacaatggaaaacaaatataggcgcacatttctcactcttccaagtacaaaagcacacttatgcctccttggaacctcgcattaccgttagtttcaaaaccagtcccaaccttactttcaaggcggcctatacccacatgacacaatatgtacatttactttcttcatccaatctctctctccccactgatctatgggtaccggtcacacagaagatcctcccgatgcaagcatgccaattttctatcgggggttactatacaggtattcaaggatgggagttttctgtagaaggctatagcaaaatgacgaaaaacgtactggaatacaaagatggtaatactctagtcggtaattccattcattgggaagagaaagtagaaatgggcaaaggacgcaatttcggcatagaattcatgctggaaaagaaaaccggacgtactaccggatggataaattatactttggctaaagccgaccgtatattcagtaaaggaaatgtaaatggagggaaacgttttccctataaatacgacagacgccactccgtgaacatcacgataaacaggcgcctcaacaaaaaagtatacatgagcgcttcttggatttacgcttcaggaaatactgccaccctgcccaaagagaaagcaaccatcattctccccgaaggaagctatggatggggacatatgggaaatacaggcaacggggttgtttttccctttgaatatagctcttctcgaaataactaccgtctgcccgccagtcatcagttgaatctaggattcaactttcacaaaaagacaaaacatggagaacggatttggaacgtcagtattatgaatgcctataactctttgaatcccaatcatgtatttatagattattacacggatgagcaatcggaaggaaaaaagattcctgtgatacaaaaagtcactctccttcccttcttaccttcattctcatatacttataaattttaagcaataatgaaaaaagcacttttactcctttcatttgttcatttattggccgcctgtaccaatgatatagaaatattgcctaatgatgaatctcaaaagctcatcgtcaacgctctgataaacgcaaacaaaacgaacaatgctatctttttagctttatccggctatcacgaaccccaagtagtaaaaaatggaattattcacctttatattaataatgtattatcggaaacaatttcggaatgtacctatcgtcctaacaatgattcaccgttagactatcaaaattatttttaccagataagcagccgttttaaaaccggtgatcaagtacgtatcgaagtagaaaccaaagacggaaaatataaagcgaatgcagaagcaacagtatatgagcccattgaaattatcaaagcggacaccattgaatctaatcattctctatcagagacttcggaaagcctttggatatatcaagcaacaaagtggaaaataaaattacaaactcccaccacaaaccattcccaatattaccgggtcaacataaaacaaacatatacttaccgccttactaaccgcaaaactttacaagactccactgctatctccacccaatgggaatgtagcggatattatgacactgcattaatggacggaaaacctggcactcccaacaactctgatcctatcattaatttcatccccactataaacaactattataatgtattcaatgatgcttactttaccaacaaccaatataccatgactttagacagttggtatagtttcctattagacaataaactatataaaattaaaaagataacaggaaaagctatcatacaatattatgccatatccccggctgaatatcaatatttacgagccgccaatgcatatgccgaccatgacagtagcaacctgttggaaacacctgtcatctttcccaataacatcaaaggaggaataggtatttttgccatagaaaatccgacagaaacaagcattcctttaaaatccatcgaagattattagaaagctttgccactttcggatctctgttaaattatttatcttccaatgaaatctgaaaaggagaagccggtagtccggttctatttttcaaattcgcatgaaccggattatcatcccaaccataacgtaccgttacaggatgagggatatctttatgccataccgccacctgattcccattaacaacaactgcttccgcccactgaaaatgcccatcggcaccggctatcgcaaatcccttcaattcatctaccgcccataatttatcagtcccggcttcgaaagaaagaacagcctttccttcatgattgacagtcatacccgtacacataggcccactgtgcacactctttttatcaccatacacccttcttttcaccaacagggagatacgtcttgccagttcttttttattcaatggatgaatatcgttccactcgcctaaatcaatcgctaccgccaaagctgcattcgggactttcaacgctacttgccgttgcgcttcacgcaaagccgcccaattactttctaccggctccgaatgtgtcttcatgaaattggccagctgtacaataaagaaaggcaattctttatcagccagtttctcacgccagtcaataatcatggcagccagcaattcctcatattcattaggacggcccgtattcgtttctccctgataccacaacgcaccggtaaaggtcagattacgcagaggagaaatcatggaattatacatgccggtaggaacattctgaaaagagacactgttggtgcgtgcaggcatctcacagcctaattgatatttccagcggctggacaaacggactgtatctatcccccatgccagacaataaggtttatcgggcacaaaactggcggcccctccgtaattaatcagccggacagtcaccagattctcaccgggtttcaatatagaagccggcacccgataaatacgcggcggatactgatagaaagtgttacctacaaaaatcccgttcacaaacaccgaatcggcatccaccatgcaccccaaacgaagaacagcctcttttccggcttgttccgctgatacattcactttctgacggaaccaatgagagccactcaccggatatccattctttcttccccattccttggaaaacatatctacagtctgccagtccgtatcatccagttccggacgattccagcatatcccgtcatgaagtccccggtctcctttgtacaaagcggtatcccaaaaacggttcatcatctgtcccgaacggttgcacaactcacgatactcatccgaatcaaacaaatcacgctcgtgcaactgacgcggaaacttctgcaaggcctcctcactcatccaagcctcgacggaacttcccccccaactggagttaacaatgcccacaggtacttgcgtctccctatacatctccttggcaaagaaataagccaaagcagagaaagaaggagcagtttctttagtcagcggcatccagtccgctcccggcaaatcgtctttaggtccatgcaaatcattgcctaaaggaatcttcacataccgtatcatcggattctcatcccttgctatttcctcggcaaatttatcagtcacccgtccggcggtcaattccatgttggactgtccggagcaaagccagacatcacccactagaatatctttcaaccggatatcattcacggtcatttcaaaagggccgcctgccttcatgggaggcagctccaccagccacttaccatcttccccggctaccgtactgaatttcttctttttaaaaacaacggtcacattctctcctttatcggcatttccccatattttaacgggccgctcacgttgcaataccataccgtccgataggatggcaggcaatttcacctttgcttcggtccatgcggaaaatgcacaaagaaccgacattactaaagctaacttatatttcatgtttcttataaagttaaaaaccgtaatttatttattgaacccactctcgggacattcatagttcgagatttccaaccggaagcgtttcatatcctccaactcgtgtacaggacgttctatgccagccgggataggcatccctgagaaagtctggaaataaagcagacaagcatctttccaccacacggcgtcacgcatctggattttcaatttcgactgcacttccctgaaccggcgtacatctacaaaaggttccacactgtcccatacttcttgaaaaccacgtacctgccgcacacctctatcgtatgcatggcacaactccccccaaagcgtacgtccgcttttcatctgatgctgccaaggcacatgatggaaccaaagcaaataaatctcggggcaagttgccttgtcattgtaaatctgacgaagtgaatcgggatactgagaaacggcatcactccctttgctgctacggtcgaaaccgattccctccttatctgccttatgataataagaaggtagccagtccggacgagcaccgggcacactacaccacggttcaggtccataatggtgcccccatgcaaactgatgatgcagccccaacggcatcatataattcaccaccgcctcccggctctgcaacatcatctctttgaccggacggacaaatgccggctgggaagtaaacgtctgccgcaaccactcatccgcaatccggtctgaagtcagcgacggattccatgccaaccgcccgaaagcataccaattggcttgtgcaaaatggtgtccacaccaattcacatccgtaccgatgtttgccacacccgccacagctttcaacctatccggacgtacttcaccgaaaaactcctcccataaaggagccaaataggccagatgattggaaaagcctaaatactcctgagtgatttgaaactccaccatcatggaagtctgcttcatagccgtgaacaaaggactataaggttcacgaggctggaaatctatcggtccgttctttatctgtactattacattgtcatgaaactgcccgtctaaaggcataaactccaaataggcctgcttggcacggtcactgtcggtaggactatagacaaacgccctccacatcacgattcctccgtagggtttcaacgcatccgccagcatattcgctccctcggcatgagtacgcccgaaatcacatggtcccggctgcccctccgaattggcctttaccaaaaaaccgccaaaatcaggtatcaacgtatagatttctttcactttccgcctccaccaccggatgacctccttgtccaacggatctgccgtatccaacttgcccaactggataggagatgcaaaattaaccgataaatagacctttataccataaggccggaagacatcagccaatgccttgactttctccagactgccggttgccagcacttggggcgaggcattgacattattcagcaccgttccattaatacccacagaagcattggcacgggcatatgcctcgtaacgtggtgacaaagttccgggaagttcttcccaattccacaaagaacaaccagcataaccacgctccaccgtaccatccagattatcccaatggttcaagatgcgaagatcatacacagattgttcagtaaccgacagaggtactgtgacctgccccgccgcctgcatacgcaacagactataaacaccataaagcaatcctgcctcggtggatgaaagaatacggacctgatgttccgaagaagtgatagcaaacccatccccctgccctgtcctctttttctccaaaagtacaggctctcccttccaggcgtttttcaactcagcaatggcaacggctatggtgggtgacacttttcctttatatataacttccacctccgcaccttccaccgggcgcatcaccggcaaccacaagcggctaccgtcttcttctgccggacgggcattgtccggtcgtgtaccggcctgcaacattcctgccgccaaccacccgcacattattcctatccaaaccgtcaatcttatatttttcattgtccattcagtttatttctccggcaaggagattcgtccataaacagataactatcctcataaccgccataatccaccacaatcttttcaaatacgatggcaggctccaccggtttcagaaccaatgtataggttccgtccgcacggtcgggcaggctcaacttcacccgggtcttcaccacccgacgggccactgtgggatacagtacgcgatatacattatccggatgctcgttcaactccgcattgaaacagacagtctgctcctcccctccttcaaaacctaccgtgtagcgatgaccttcccgtctgaggaagggcagggtggatttcacaacgacatacacatttaccgtatctactttttgcggtattttcattttataagagagcgaagctccctcagcagactgtgtataaggcatcaaagccactccgctcagcgtacgtcccatgtgcggtatgactgtccaggcagtttccggtgccgcagatgatgcaaaataatgctccgcctccatggaaaccacccctttgtcaccggcaaacaaataccctcctacagcctgttccggttgctctatccagtaaacttccggcaaacggtcggcagggaaatcatcgttccacgaagtatagcctatatgtttctgcgtcatcattccgttccacttgcctcccgacatttcttcgttgtattccctgcacaattccgcatcgcgcctaaacgccttctccaccttgtcggcccactcattcgcctgcggattgttctcctggtacaatttgtgattcatggcttgtgcatagtacatttcatacagattggccatcgcctgcacaggaaaaagaatcagttggcgataagcatccctgtaagcggcctccagtttcaaatactgccgcaaggcttccgcctccagcttcacatattcatcggccacctgcctccattcccccgaagccaagtgataagtatccttatccagcatctcgggagtcacgcgtccattgtacttgcaatacaggttcaggatacgcatggcctcatccgcctgttcctcaccgaactgctgcgcacagaacgctcgtgtatgctccaacagattccctgccgcatagcgttccggattccaagccatattcataaaaagagtgataggatactccatcggcttcaaatcacccacattcaatatccaaagcttatccaccccatagctgtaagtcaactgaagctgttcccacatattttgtacaggagttacattcaaccatttggaattacggggagcccccacataatctacatgataatacatcccccatccgccggaatgcttccgctcctttgcatccggcaaccggcgcacatccccccagttgtcatcactcagcaacataatcacatcatcgggcacacggagtcccatgtcataatagcgttgcacttctttataaatagcccatacctgcggacgtttctccggtgcttttcccgtcacttccttgataatacgacgctgattccggaatatcttctccatcaggcgcatgttttcctcatcacgcggcacatatttgtcatcttctccttcctttccacccatcggagtatcaccgtcacctctcataccaatggtaatcaaatcttccgtatcggccgcacgctccataccttcacggaaaaaacggtcaatcacttgctggttggaagcatagtcccatgccccatattcgctgcgcttcctcacccattcctgatgattgcgtgccataggctcatggtgtgaggttcccattataatccccatctcatgggcggtcttgctgttctccggatcatccgcataaaaactccaaccccacatggcaggccacataaagttaccgcgcagacgcaaaatcagttcgaacacacgggcataaaaacgatgatcaccataattcgtgccataagtgtgtttcacccacccggtcaggcaaggagcctcgtcattcaaaaagataccccgatactttaccgccggttctcccgccgtataacttccacgcatcatcgaaagattctgccggggcatcaccggcacatccgcccagtcgtaccacggcgaaacaccaatctgttccgaaagctcataaatcccataaatcgttccgcgtttgtcacttccagcaatgacaagcgcttcattcactccgttcaagggagcagacaccacagtcatcaggtatttctcattcttgccctccagcaatgaagcatctatctttttcgcctttaccaattcccggatataacggcttttcaacgtacctaccataatcatgcgctttacaccgggagtatagcataacccggcagcccggccactcacccgtttaaagtcattctgaagattccttaccgctatcatcacaccggcatcctcctgctcgtccaccaatatttcattggccactccgttttccatcagagtgaaacggtcgggagccagccggtcaaaagtaatccctttatgatctatagctcctacattcaggcacaaggtggagaacaagaatatccccacgcatttttttagtttcattctattcactttttagttaccgtattcaaaataatctatatccacatatcctcccaaatctttagtagcataattaaaaatagcaaacttgcttcccataaagaatttggtataatcaaaaaccattttacaaggctcccctattcgtttccacgttttcttgtcataactgtagtaaaaagtggcttcatcttttttatcggcaaagtcgccctccatacgaagatagaccacctctttttcacaatctatgcgttccttctccagtacttccacagcagtcacccttttttcccggtccgaaagactgacagactgatgtgacatcacccactgctttttcccgttctccatgaccacagccagcactccggacaacccattaaaagcactgaagcccgcaacatccccttctttcatcttcgagacatccatagctagcacaccgctgcatttcggcccgctcatacgctgggtcaaggtattgggagccagaaacagattatccaccacccttccggtcctcaaccgcaggaaacccggacgctctgtcagcgaccagcaattgtccaacggattatggttccactgccagttcaagctcaaccggtcggtgtcgaaatcatcacttcccatgatacttcctttacacttctctccggaagcaggcatctccatacactcgggcacacgtccgtccgcatctcccagtatcggccaaccgtcttcccagcggcagggcatcaatgtgggcacacgtcctatgccgcccctatcttgaaaaataaagccataccagtttccgtcaggagtatcgactatacagccttgtcccacgccaccatatccttgaaattcggtttctaaaatcacctttttctcatacggaccagttatctggtcggcacgatagcacacctcacgacgcaaccgtccgggaatgctccagtccatggaaatcatcatcacgtaatatctgccgttatgcttgaatgcctgacttccttccagaagtccctgctcgtcggcatcccgctcgaatatcttttggtctatacctcccggctccacatcgctcaggtcgctcttgagctgacgaagttgtccggtgccataaaacagatagactttgccgtcatcatcaaaaaacaaagaagcatcatgatgatgaggcggacgggagactaatgtccattcgcccgccggatcttcggcggtatagatataaccacgatgaggttcatcattgggtgagaaccatacatagaaccgtccgtcatgatagcggatgctggaggcccattgtccgcgaccatataccgtgccttccttcaaatcataacggggcaagtcagtaagtcgttgaaacacataactgatcgtttcccaatgcaccaagtcctttgaacgcatcaccggacaacccggcatcaggtgcatggtggtgcttaccagatagtaatagtttcccacccttatcatggaagggtcaggtacatccgcctcaatcaccggattatggaagatttcccgttgttgtgcaaacgcccccgacaaaccaatgaagcaggtaataataataatgatcttcttcatttctttttctactttctatttttgaacaaatgaggcacaaaccggtacaagcaacgacgccatgtcaaccactcgtgtgccgtgccctgcgattcgtaatagtccacatgaatacctattttgcgcaaagactctgccagttttcgggtaccgaactgttcttccgttccgcatcccaaaaacaagtaatgtacctgcttgttaaacttgccggcatcagcaaacacaccgtcaaagcaagtcttcacatccagtccgaagatagcaccgctgaatgcgccaatatacgaaaacttgtccagatgaggcaatgtggtagtgagagtctgatgaccaccccatgacaatcctgccattgcacgatgttcacgatcagtataagtccggaacgtcctgtcaatcatcggtatcaagtcctccagcatcaccctgtaaaaagaggcaccatacaaagctctctcctcattcacatccttccctttgcgaggaatgaaaggagctttcacatccccactgtccatcacaacaagcatcggcacacattgcccggaggctatcaggttatccataatatgttgcatacatccctgtgccgaccagcccgtctcatcctcgcccatgccatgttgcaggtaaagtaccggataacgttttttcaccttggtttcatattcagccggagtatagaccatgcaacggcggaattcctttttggcttccgaataataagtacacgagcgcacctgcccatgaggtactccctgctgaggacgatagtaatcaccttccactccctcgggaacctctatcccactcgccatacggcaacaaccaaagaaagtgtaactggacggatcggccacctgcaccccgtccgctatcaaaaaataataatggaatcctacgaccaacggatcggtctttactgtccagaagccatccgcgtccttctgcatgtcatacttcttaccgcaacagtctacctgaagccttccggcttgcggagcatagaaacggaagtgggcgcaatgctcctcgtccagccgcggatactcgtaacccggaatattggtagatgcggcctgcgtcctgtctttcacctcttgctctgtcatttcctgccggctgaatttccaccagtcaaaatgaaacagttcacatcctttcctgcctttgaacacaaaatagacatcatgcacacccgtcacaggaaccgttacatccgcctctatacttgtccaacattcccatcctccggtatgaggaaccctcatttcagctatcagcgtcccgccgatgctgtcggtcctgatttctatccacccgccacgaagggcactggcaacagacacacaaagacacttgggcgacaaatcttcaaaatccacctcgcgtacctttatataatccccgtcatgaattccggatacatacacccccgtctttgcattccattccgactttactccctcggagaaagctatcgtttccgcctccacacgttgataaggagtcagtgtgcctaccggcgacaccccttctgtcgtcgcattaattatcgggaaagtaccatcggggttgtaactgaactgctccactgccacgctacgtccgaaaccacccccaccgggtaatttcccggtgtgataaaagaaataagaattacctttataatccgtcactccacagtgattggtaaacgaaccggtatcttgcaacggcataatttctcccatatacttccaaggtcctgtcggagtgtcactcatcgagtaagcgatgtgttcgggtactccgccggctgcatacgacagataatatgtaccgccacgcttgtgcaaccacggaccttccgtatagatgtccttgtatttctttcctttctcccgtttgtccggccccggagaaccaaaactctctatagtctgctccaccttggacacctcaccatccagcgaaaccatatcggcattcagcttggcatagtaaacattcggatttccccaatatagataagcctgcccgtcatcgtccacaaaaaccgtgggatcaataaaatcccagctaccttcgtaaagcggtctgccgatagcatccttaaaagggccggtaggcgaatcacccaccgccacaccgatagccatcgtgtttgtcaacttggaatgcagacacacataccaatagaatttcccgttgcgttcgatacattgcgatgcccaggcacgatcgtccgcccagtcgaaagactcgatggcaagcggagaaccgtgatcggtccagttcaccatatctttagtagaatagacgcgccactcctgcatccagaaaaaatcggcatggtcctcatcgtgtcccgtgtaaacatacaaggtgccatcgtgcaccataggtgccggatcagaagtatagcaagtctgcacaatcggattctgcgcctgcaacactccggcaagcaacagggacaagccactcatcatacatttccggataccggataaatcacattcaagtttcatattcatggtattaaattcacaaggctgtttttacgttccgttcttcactgctcaacaagagcaaaggtaaggacattcgccttatatcggagtgtaaccatgttacatagtcctttttccatgttacaaacctgcccgatatggcacaaagtaccgaaattacttccttatttattaggctatatattcttttttgaattatttttgtgcacctgaatttactgggatatttatattatgatgaaacatacgattcttatactatttctttttctgtctttgttgtgccacggacaatcgtacaaattcttcacaacagacagggaactttccagcagtctgatcaacaaaatatatcaggaccggaacggcatgatatggattgccaccgaagacggactgaaccgctatgacggagccaagttcatcacctacaagcatgacccggaaaacgagtactccctctgccataactacgtacgagtgctgtacgaggacagcaaaggacggttgttcgtaggaacctataacggtatacagctatacgatccggaaaccgacagcttcagcgcgcgggcgcaatgggaaaatggaaagacttttgacagcaatatcatgtccattctggaacgtaggaacggagaaatatgggtatcgggaaacaacttgtgtaccataaccatcacacaggggaaactgactgcacacaaactggacttacctatccccacccaaatgacagactacatgatagaggacagacaacacaatctttgggtaacacagggtgagaatggtatctaccgcctctctgcggacaataaaagcaagcactttctgaaacaagagaagggaatgaccattgtagacctctatgaagacaactacggagacatctacctagcaaccataggcaaaggattgctgaaatataaccaaccagcagaagagttcattcctatcctttataaaggaaaacaaaacctgcctatcaaatccatctgccagataagccaaaacgagctttgcctgggcacggacgggaaaggcaccaagattttcaacatccccaaacagctcatcacggattacccttttgataataattacctcgactccggtacctccaaagtacactccgtcctgaaagacaatgcaggaaacctatggatagccatttaccagaaaggggttatgatgattcccgcacagcccaacagtttcaagtacataggctacaaatcaataaacaagaatatcatcggctccaactgtatcacctcactctgccgcgaccacgaaggcatattatggataggtactgacaacgacggcatatacggcatcaccacagaactgaagcaaaaagtccattatgccccacatgacagcccctcttcggttccttccaccgttttcggcctgtatgaagactctgaacataatctgtggttcggatcctataccaacggactaggcagactggataagaaaacaggacagtgcagctatctgcagaatctgacagacaagaatggaaaccgtatccaacgcgtgtatgatctggttgaagaccaggacaaacgactctggatagccaccatgggagccggacttttctattatgacttgaagacaggacagtctgtatatgaccctaaattcaatgctgccaccaaaaaatataaatggataagctgtcttttgtatgccggtgacaaccacctttatgtaggaacgtatgacggaataagatgtatagacctgagtaccgacgacttcaagactgaagaaatcctgtccagacacatcatccactccctttatgaagacccccaaggcaacatctggataggcaattccgaaggactggcggaatggaatccccaaacccagcaactaaagacctacaccaccgcccacggactatccagtaacgccgtatatgctatcaaaggagacgggcaggacaacttatggataagcaccaatgccggaatgtcacgttttaatctgaatacccacacgttcagcaatttctatgcagacgacggtctgcaaggaaatgaattcagcaaaaacgcctcttttgccgaccacaacggcatactctggtttggaggtacaaacggaattacctatttcaatcctcaagagattacgaatcccgcaaaaaaatggaacgtacgcatcatcgacttctatctgcacgaccagcccataaggaaaggaatgttgtcgggcggaaaagaaatcataaacacctccgtctttgaggcccgggatttccacttgtcacataacgacaacgctttcagcatcgagttctctacccgcgaactaaataattccgaacgtatcacgtatctatataccataaacaacactccttgggtcaaacttcccaaaggagtcaaccgggtgtcattcagcgaccttccccccggcgattatcatttccggatcaaagccgaagattatctgctggaatccgacaccgatgaaatcaccattcacatcgcaccggcatggtgggcatcgggctgggccatgctgatctatgccttattggcagtagcagccgtctatggcatcatcctgcaaatgagacaccgttaccgcataaggcaggaaatgatgcaacatatccatgccgaacagataaacgaagccaagctacagtttttcatcaacatctcccacgagatacgtactccgatgtcactcatcatcagtcctttgcaaaaactgatgacaaacgatacagaccacgaacggcaaaagaactaccgcatcatctggcgcaattccgaaagaatcctgcggctggtaaaccaattgatggatatacgcaagatagacaaaggacagatgtcactcgttttccgtgaaaccgaaatgaccggattcattaatgatttgtgtgaaacctttacagaacaagcgaacaaaaaacaaattactttgcagttccaccacgagggcgccgaccacttaaaattgtgggtggacccggtgaacttcgacaaaattatcctgaacatcctgtccaatgccttcaaattcacccccgaaggaggcagtgtggacatacggctacgcaccggtaaggactccaccctgccgaaaccattgcaacagtatgccgaaatcaccgtgaccgacagcggaataggaatcgcccccaaagaaacagaacacatattcgaacgcttttaccagatacggaatagccaaaacaactcaaacataggtaccggtatcgggctgcacctcacccgctcactggtggaacttcatcatggagacatccgtgtagaaaataatccggacggacaaccgggatgcagctttatcatccgtatgcctctgggatgcgcccatctgcgcaaagaagaaatggaagccgacaaagctcctctcttccacactccggctccggtcctccctgttccttatgaaaccgaggaagaagaaaacggaaaaacacgaaccaaaacgaaatacaaagtactggtggtagaagacgatgaagatatacgccgctatatctgccgtgaactggcaagcgattaccataccctagaaagctgcaacggcaaggaggcactggaaagcatcttcaataaaaccccggacttggtaataagtgatgtcatgatgcccgaaatggacggacttaccttatgccgcaaaataaagcaaaatgtgaacctgaaccacatcccggtaatactgctcaccgccaagacacgggaggaagacaatctggaaggtctggaaacaggagccgacgcctacatgaccaaacctttccatatagagatattgaggaaaacggccgccaacctgatccgcagtcgtgaacggctacgcaatacctataccggacaacagacccaaggggataagatacaaccaatagaagtacagtcccccgatgacaaactgatggaacgaatcatgcgggtcatcaacgaaaacctgagtaacccgaacctcaccgtggagatgattaccaccgaggtaggcattagccgcgtgcacttgcaccgtaaactgaaagaactgaccaaccagaccacacgggattttatccggaacatccgactgaaacaagcggcagagctgttgtcgaagaaacggtacaccatagccgaagtggcggacttgaccggattcaccaatcccaacaatttctcgaccgctttcaaggatctgtacggaatgcctcccagcatgtacatggaacagcatttgaaacaggataagaataaggaagaggctgtctcaaaatagagttgagatggcctcttttgtttcatctccaattgcgacgaaacctattacaaaatactcgtcccggaaaagaacagcaagggaaaaggagtccgcaagggatacctctgggtggttgtgggcataaacaccaggatgatatacctgctctatgatgacggctcccgctctgaaaaagttattcttaacgaattaggcggttgcaaaggcatcatacaaagcgacggctactcaccttaccggaagctcgaaagcgatgcttatccccatatcacacgcattccgtgcctgcaacatataaaacggaaatttatagattgcggtgaggatgaaccggatgcaaaaagaatcgtggagctgataaacacactttatcaaaatgaacataagcataagatcggggttgacggatggacggtagaacagaatcttgtccatcggaaaaagtatgcgccggacatactcggagaaataaaagatgtgcttgatgatatagaagaacggggagatttgttgcctaagagcgaactgaaggaagctgtcacctatcttcgcaatgagtggaatgccgtggtggacatctttaattatggtgacacttacctggacaacaatatagttgaacggatgaaccgctacatatccttatcaagaaaaaactcattgttcttcggcagccataagggagccgaacggggcgccatactctacacgatagcactcacttgtaggatgaataaagtgaatctgtttgagtatctcacggatgtcataaacagaactgccgaatggcaaccgaatacaccactggaaaaatacagacaactgcttcctgacagatgggaaaaggctaatgactaaaaagggatcattagactttttgttttaatatactatatagaatcgcggagacgcttacccaaaactgacggattcatgaaggattgtgctttaaattcttcataataaacaactgtaagcaagcggattagacacttatgaaggatttgaatcaaaataaatctggatagtcttgtacagggggggctgaatcaacagaagggtcagtccgaaacataagacaacgggacagatccaacttattcatcgactccgccccgttctatgtcagaataccataaaaagaatatgattattcaatctctccaaaaagctcagccagtttatttgccaaagcctcaccacgaagattttctcctaccatgaccccttgggcatctatcaaatacatagtaggaacaaatttcactttatatatatcagcaataccttcagtatccaaaaaattaggccactgaagttgttcttctttcagcgcttttgtccattccgcctcttttttatcaatagagatacttacaatctggaaacccctgtctgcatattgcgtatagagttttttcaaattaggaatctccttacggcaaggattacaccatgatgcccaaaaatcaataaggacatacttcttaccttggcacaaatcggttaaagttaccgatttcccatcttgtgacttggctgtaaagacaggcactttagaaccgatctgactatcaggagccacactctctttcaccatttttccatagcgggaatgtttagcctcttctgacaaggcatcataccacggtttctgctcttcggtaagataagaaaacaaactgatcatcatcagaggcccccaataagactctttattgtccataactaatttatagtaagtggcatctaccgtagcaaagaacaaactatcggccacggcagatgctttgtaagcttccgtagcaacgacagaatccatcaagatcttatctttggcaactctcgctttaccataggcaacacggatatccttaaacttctcgttattcgtcacataaatagaatccaaggcatcacgtgtgctcaataattttacatatttgtccgtcaaaggagatcccgtcactgaaacctgtgaaaaattataattcacggttccattaaggttttcagaagtcaccttaccctccacgcttatactgccattctccaacatcagaggcatggaaccgtatgcatctttcaccatcaaccgtacagccagaggttcatccgccacccctttaaatataaattttccatctacaacagtagtgtccgccaccggtttttcatgaccatgacttacaggaaatagctgtacatgggatccgtcaggaattccatcaattgcagctgtcagtgtgtaccccgttaccgactgccgggtacaagatgccatcatcaccaaaacaacggcgaatgttgctaataaatacatcaatttcataaagtctgtttttataggttatttagatacattttgagtgatagttccattacccggattctgaacggcacctgccgggaaaggcataatccaaagatgtgaagccggggttaatgtataagtctgcccttcccatgttttggatagtgcacgtgcaaaagtaccttcggcattaaacctccgggcatcagcgaatggcacaatagtgaaaatcaattcattgtctttcgtacgtcggatcaagtcaatggcttctgtcaaagttgaagcctgcaagggttgatatatctccggcagaatacgggtcttacgtaccttgttcaacacatccatagcagcagagaaatcattacctgtgacctgacgtgccaaacattcggccttgatgagatatacctcgcaagtggtcagaccagccccgttgaaatatcctttggccaaaccttgatagtaagtatcctgatttaccgtacgcagtttccagcgggaaagaaaacgcgcatcccctccctcgaaactctccgcacgttccaccggaatattaagttcgctggtagcatagttagggttaccctctccacaacggaaatagtaattctccacataatcataccctgtcgctgacggtaacgacggataactgtcttcttttgtaatagcttccttatgcctgttgtaataagatatccaatcatacagagtatcattctgttccaaagccatatccgcgtatttcagcgcttcttcataattcgccatttgcaaatagacccgtgccaagaaggcataggctgctcccaaattgggatggataacagttcttgactgttggggtaatccttgttgtatggcttcttttacatctttaatcatgaaatcatagatttcttgaatagtgacctgcttgtgaggagcattaatatcggcactggttatcaaaggtacactcagtttagtaccggcagttgcagacacataggtatcagcataataattggccagtatgtaatagctcatagcgcgaatcactttggcataagccattacctcattgcgttcggaatcagtcgcttcggttgcaacgggaacatgctccagcaagagattacaagtggaaatagccatataactacggtaataagtcccttcgtcctgattgttcagtacaattctgtccgctgtttcattccacagataattggcactcgtaagggtaacgctagtcagactgctttgtcctacaaatttatcattcaacagataaagactattcgttacaggaatatagccaatggtatattcatctcgcagcaatgcttcaaaatcagccaaggtagtaggaattttgttccctttgggaacaatatccaaataatcattacaagaagtcagatttatccaccctaacactgtcattatcataaatagtatctttttcatattgctctcatttaaaagttcaaattgacattacacaaataatttggtttactatatcccccaagcatccatttcacatcacgacttttagccaaagtgaacacattttccatacctagcatgatacgtgcattttttacataaaacttctgacatacacttgcaggaacatgataagtaacagagagattcttcaagcgccagttatcggcatcaagtacatgaatggaagccttgctataaagatcggatgagtaagaattataatccttgctttctgacggaacatagcgtggtacatcggtatatgcctcatcaccaggctgacgccaacgtttactcacatccttacttgtcactcctaatcccggataggctatattggtattccgcattttgtgccccccttcaaaaagcagttgagcagccagttcccaattcttataacggagattggtattaatagccccactataaaccggaacagaagttcctaaatacacagcatcctccactttttgcggtgaactgcttacatggatatttccttccgagtcatacacctgaggctgccctttactatccagccctgcccacagatatccataaatggcattataaggcactccaacacggggataggcggcaggataatcgaactgaagaaaaatagcaggtgcttttacattgacataagtcactttattcttattgtatcccagcacaccacctacgttccaattccaatcttttcccataatgacatcactggaaagagtcaactcgaatccacggtttctcattttaccattattcatggtataagtagaaaaaccaaaaccttcagtaggtactccattggtattggctaacaaatccacgcccgatttattataatattcaatagaaccgttcaatcgatttctaaacatagagaaatctacaccaatattagctgtagttgtcttttcccaccgcaaatcaggattaggacggttgctgatagtcccttgtatgccgcccacatgggtattattattataataagccgtcatataaggagcagaattcttggcgatgttaccaccgataccacaactgaaacgcagtttcatcatatttataaatgaaactttaaaaaaagattctttgtccagattccaaccagcacctaccgaccagataggtttcttctgatacttggaaccagtagcaaacaaattggtacgatcccaacgaatgcttcctgtcaccatatatttaccatcatacgtgtaagctgcattcccataaaaagaaacaaaacgatttaccagttcatagatgttggagatatcatttttattgaatgatacatagtttcccaaaactccggtataagtattactcagcacccgttcatcaataagatcataagttagtaaagccggatcataattataatatttccgattattgtattccgtcttattttcacgtacttccataccaaacaaagcggtcacatcatgtttttctgcaaatgtcttgttaaaatccaattgctgacggaaattataagcacggatactattagtccccgttgtataaatattgccataaggaagattataagtagcctggccactcccacttgcatcagtagcaaatgtatttactttattacgcacagcatagctttccttatcttgcaattggcttgtcttatattcccctacttcatattggaacgaagcagtgtatctcaaccagtctgtgaatttaaaattaagtctcgcaaaagtacgattactaaaattcttactcttcgacaagtttcttcccaattcgtccaaaggggtaatatccatactatacaatccgtaagaagaaataatttcctgttgtgacttactgtaccggtccgcagccgtgttagtatagtagcttccatcgccattcaacaacgaactataaggaacataattatatccgggtgaggtcagattataactctgcgttgtaccatctccataattcagatacgttcccaaatccagactcaaccatgaagtaagccggctagtgttctgcaaattcaatccgaaactctcgctgtcagtatatttatcttcttcccggttattcctgtaagacagcgaagcattaaatgtatttttttccgttccacgcccgatattcaagttatattgttgcgaaaacggatttcgtttaccatatttcttcatatcatcataataacggaatccctgtgaagccagttcatgtagcgtctgctccatttgtgcttcgctgatcgcacctgtatgatgttttaaaatagcctgtacccccaaacaggaatacatggatgcattgtccaacaaattctgtgcatattgggatgctccctctccttgaagattaggattcatggccgcccactccttttccatctctatcatgtcagccgtatcggccaagtgaccggtataaaaattataagggcgtactgtcaatgtcgctgaaaatgatatattcagctgattctttccggcttttttagtagtgatgactactacaccattagcagcacgagcaccatagatagacgtagccgcggcatcttttaataccgtaatattctctatatcctctatattcaaatcaggtacattttcgacccagttgcccagtccgtcagaaatagttttctctaccggaaacccatcaatcacatacagaggagtagtaagtccgttcatcgaagtcacaccacgtatcttaccgtcactataacctgctattcttccctccatcaatgagctgacactacttaaccgttgagtttccaactttttcgaatctactttcgcaaatgaaccggtagcccgttccctagagatagtctgatatccggttaccaccacctcgtccagcagttcggaggccggctccaagataattctgtaactgttcgcacttgtcaatcttactttctttgattcatagcccaagtaagagatttctatctctttcgctgtgcggagcagggtcagccggaagtgcccgttcatatcggttatgacagcagctagttcctcccctttcgtctggctcacctgacggatgtgagcggcaggcaggggatctccattctcatctacaactataccgctgatcatccggtctgtttgtgcatatgccattgttccacacaaaaacaatgcaacgaaaaccatcgccagtcgaagtagctttccgtggtaatctgaatgtttcatactcttcatagatttaatattaatactgtttataatcactttttaagttccgttttattgttaaaacagttttgtataatccgcaaaacgaaatgtttcgacttttgggaacgaaacgttctttttcccaaaacgaaacgttctttttttcgcacccctaccctgcccttttccgcttaatttctcacttctaattattactaagaaatttggtaatctcgccaaaaatcgctacatttgtatagtataaattggtgtgttgtgcactctctcacacatactaaagcactatcaaatttcattttcttaaaacattttcgaccggcttacgccggtatttataataacacgaacggtgttcggaaaccatccgaacaccgttctttcgttttagtcgcttcgctccacgctttggcgctttgcgcttacaacacttcgcgaatcgctttatacgcttccacgctttccgcccgaacgagtttgccgcggaaggccagacgggagccgacatacgtgtccgagcccgatgcaacgttactcgcatacgcaaccgacacgccgccactcgcatacgcattgtaggacccgcgatagaccacacggctggctgcggtacttatccagtatttatcgcaataatatgtactggacgagccgttagctgttcctaccggtacgatatccatgtatttaccatgagcaacacctgttatccactggtcactggtcgttttacccttcacccaacgcaccgtgccgtccggcatccaaatacgccatttaccttggttgccactatcgttgggtaaatcaacaccgtccatcatctcgtacttatggccgtagatgtcctcatagcccagacaactgatattgtttacctgagtcacggtcggagaaccatactcgtcctgcccacgataccaagcgtactggtggatagaaccgtccacgatggaattcgtgatcttgtcgtttattttatacgcttcgtcataaccgatcgtatcctgcataccataaccggctgtaccgcccgtgatacgattgttcgtatgctgaccgcctccgcactgttcctggctgtcacgacggccatatcttgcgtaaaacaagttcgctatacgggagtgcatcaacgcgtctatctgttgcataccgcgctgaaccgagtaataatgaaagtcgatccagttcatgctggccgtcgtggaattacccgttatgcatgaacgcaacttgctacctaccacgctactgcctactaccgcacaaagatgttcctcgttggccacccaatcgggctccatatcctcgatcttgtcggagttggaaagaaccaccttgtcaaactcggccgtgttcaggatcgagaagtgcaaggccgtggcgtcctccggaacatccgatatcaagtacatgccggcctcgaacttcagaccgatcgtagggaccacgatggttttgaccacgtttctggagccgtcaacaaatagactgccgaccaaacccgtaccgggaacactcggaaaacgtacacgcttatagccttgtacatccaccttgcagactgaataggtcttgtccgtgctataagaatccttcaacgtgggtttgccactcaaaagtttgcgctctgtaaggaaaccgccctgcgtgtctttgatgtcgtccaacgtcagcaccgtcacatccggaacaggaggcatatcgtcagggccgttggaactgtaacagctgtaatatttctcgttcaggtagtcattgacacctttcgaccaaaagaacggttcgtacatcatccagtcgccctcgctgctgtcaagtttggctgcgctgccatcgtagtatttattactgctggtatcatccaacggacaataggtcatctcgccgtccggattgttcacgtcaaccgtctggcccgccatctccactttacggctcgtgggctttttcgtcaccttggcaagcacacggtggcgcttcttgaggatcgccgccacgtgggcattcatgacgtaagtattgccatacttataaccggtctcgttgtccgggttggaaatgttggcatcgtccggagcgctttcgtccgactcgatgatgctgtaggccggttgtacgatctccagttccggataccgctcacgataccggtcggcctgttcgtcatccatgtactttgtcaggcagagcctgccacgcaatccggaatgacggttgtctatcgctccggtggaggtataagtaccataatcgtagtatttcccgagcagcctgccgtcatcctccatatcgatgtcaaggacaaaacgctccagtttaccgctaccgttcaacttggcctgatgaagacgttccagcatggcaaacccgtcaatgcccggacaacccatgaaccggtagcctcgcacgttaccgatgccatccagtaccaatccgctctctgccaacctgggaagatattccagaaacagttcctctatcgtttccggcaagcataactgcacaacaggcgcaccggtggcaagtttcacgcgggtaagccccgtgcctctcacgtccagcttcttcaaccgtccctgccagctcaagtccaaggtcgtcacgttgccgttatcgccattccgtgccagcaggttgttgcgcatattaagctcttccagaagaagcatgccgttcgtagaggccatgaatgaaccgttacgataaccgctggctttctccacgctcatgtcaagtttaaccaatgaggtaagcaagccgaaattgaatccgatggcgaacgcgtcctcatgccacaccagctccttgattttggccgcgccgataatcttcagcgggtcgttctcaccgaaggcacgggccagctgcagggagtggagcacgtccgcatccaccacgccgctgtcggcctgaacgccgttgctagtggaaagctgcacgcggtacgggatggtcagccggtactgcatcagcttcagtttgtatgccttgtccagcgatgccgtactctggtagaactgggcgcccagcgtagagacataaccgtactccacctgcttcaggtcatacctgcgctggatgaaatagttacggtgagctttcaacgaacccttcagaccgtagatctgcggatacgtctgtttggcaccgtcagcccccaccggcatctcgttcaggaacggatacacatacttgaagatgcctgatttgttgtacagccggctgcaccacttcttcatctgctcggtgtcgaaatggtcaacggccttctggatgctgaaggcactcatgaagctggtaccgccgttcacacccctggtcatcacttcttccagcagattgcccatattgcccagtatcaggttccacagccagctgttgtgtccctgcatcacataggccccgtcccgcttcgtctgccggttgtcgtcatacttcccggtcaggaacgacttgttgtccgaacccagctggcagtcaccgtcgtaataggttatccaccacatcacgccgtcccatgtccgcaccagcatatttttcgccagctggtccacacccaggttgaactgtacatacaggtagtaggcggccaggttgggaaggttgaaatacttcccggcttccgccttgaaggtcgggctcacccatttggccgtcgggaacttgttgccgtcatcctcatagtccaccccgtcaaaggtgtgcgtctccttgttataggccagattcttgccggcaggcgtttccctcacgcatttatagaggaaactcatcatgcggtcaagcgccttgtacatcttgtcgtacttgtcaccggtgcccaggtgttccttgatgttcggttcttcttcggcatcgcctccgccatcgttccagaacacgtctttcggatggttgaactcgaaaccgccgtcaaagttgaaatccatgaagtccgtatggtcgggctccgtggacggcagccagcggaacaggcacaggtcgttcgagttgttcaacgtctcgatgcagatgggcaggtattccttcggccggtcgccgttcgcctgcaggtagttcagcgtatcaccggtcccccactgttcttcgccgatggtcttgtcctggccgaatatcgggtagctgtcgctcttctcgttgttcatgttgtactggccgtagtaggtcagatcctcatccacactctttgccacaaacaggtcacagggcaagccgtcaatggccgagcgtatgtcttccttgcacgtatccgcatggtcggcggcatactgctgggcaggggtcaggatacccatttccttcatgccgtcatggatgaacttcgcgccaccggtgttggtggtcatggaggagtccgaaaagtcacacttcgcacaggcgagttttgcccccaccgagttgtcccgcagtcggaacaggttcttcttaccctccgtagctgtcgggttgctctgctgcccgttaccgtctatctcgccgtagctcatccgtgccgtgtaaccgctggctgtcttctggaagtagaagcgtaggttcttgcgggcatagttcactgaactggtaccctggatacgcagataaatgtcacgggctatccagtccagcgcccggttctcaccgttgtagaatctaacttcccggcacagcttgttggccttcttgttgttcagctgggccagcgcatccatcacgttcagcgtgtcgctctcgcttggcacctcactgcccacgctgcccgtgcctatcagtaccaggatcgagttccgccgcttcttcatcagtcccatcagcttctccatgctcaccgtgtccccctcgttcagcacgcggttgtcctcatccagcgagcgcacgcccggttccccgtcggcatcctccagatgattgcggtccacgatgtagttgttaagcacctcgtccgaggtcagcgccttgttatagatgcgcacgctcttcacgttcaggtcagccccctccgatttaaactccagctggctccggatgtcgaagctcaccttgtccagccacttcgaggcggccgactcctccccgttcacatagaagccgatcagcgtccgctgctcgttggtctccacgtccgggtagaacacgtaagtgatacggatattcttaccgggttcaaacttcgtacccaccgagtcctcatagcgcaggacctgaccggcatccatcgcctccgtcaccacgccggtaaggaacttcgcctcctccggggtcaccaccagcccgtaacggttgccgttttgcagggtgcccagacaggtgatcagctccgcgtcggtgtcagtcacgttggccgtgctgtattctatctccaacgtcatgcccacgtcgcggatggcaaaaccctcgggcttgtccgcctcgttgaacgggcgataaccgccgtctgccgtcagtgtcatgcccgcaccgccggccagcagcaggcggtccttgtgccagccgcttcctgcgccgtattcgttcacgctccacagcacatcacggaattccatccgtttgtccccgctcacccagctttccgggttgttttccgtgttgcttcgcccgaaggcatcgaacgtgcacacggcatccggtgccagcgtggcttcaatgtcggggtgcgatgtggtgttcacctgcacctcaagcacggcatcaccgcacgacacacggtaatccagcggttccacgttcacgttcgtacgcccgtagctgccggtctcaccgcgctgcagcaggtcttccttcaccacactaccccggctggtcactttcacacgggccgtgtacgcatccctgtcatagccggcatacgtgaagttccacgccgtgaactgctcggcctccagtacggggtgcttccagtcacgctggaaccctgccgcccggtggttgaacatcatgccggcataggccgtcacaccttcctcggctttcagcagggtcaggtagtgtatctcgctcaccacgccggagttctcgtgtagcgcataggcttccaccacgttcatgccctcccgcatttcactcagcgcaacggtgacgttcttctgctggacaccggaaccggctgacaggccaagcgtatagggctgcccgccgttgatacggtagtagatgttcttctcgccactcgttcccttagctgtaaatgggatgttcacgtcgttccggtatcccccgtcagccagtccgttcccaaccgaataagtggtacttagttccatagccaccatcgtcaccctggcggtagcggttttcatcagcgtaccgccatcataaccggcctgcgcctccacctgcacggtgtaggtcgtggcatccttcaggtaaggcgacgcgtcaaaagtatagctctgaccggccgtaacgccgacaaactccgcatcctggaattccgaaaggaccgtggagccacgttttacgaccaccttggccttcaggtcgctgtagccactcacctcgccgccaccggccgtgcccacgccaacggcatatctcaccacgaaaccggtacccaacgacaaatactgggaagcgggcaaggaggaacccgaagcatcggtcaggtctatattcaccaccaccttgtcatcgtcgctatacttggaaaagcgcacctccctgtcgctttccccgccttcgccatccttctgcgtgactgtcatcacgtactgagtgccgtcctcgctgtccgtcacgtcgatattcgtcacggtacccaccagcgaggcgaacaccgcgccgctcgtgggggctttcgtctcaccggcggccagctcctccgtaggggtggccttgtcatcaatacttttgatatagttctccaccaaccggccgctcaccggaagattacccgtggattcgtcaccggaccaatcggtcttctgcatatccagaccgtcctcgtcatacacttttttcgccatatcgttattctttaaaagttatttcatccgtttccagccatccgttcggctccagggtttgtcaccgcgccaaaagcccgcgccgaaacagctccggatggcttgccaaaccagcctggcccctatatagaccgtcgccaccacccgttcgcctacacggatggctgtcacctctttgtttccaacacttatcatacctattcctcctcgtaaatcaggtaaatggtcttgccgtccttttccgggagactttcaaactcctcctcactcatctccttatgtttgtagccttgggctatcgcatcctcggccttcttcgcggccgcctccgcctttgccgccgattcacccgccgtttgaatggccttttttgtctcctgggtggccgcttccatttcgggagccaatccctccaccctttcagcggccttgatcgcccgggccgccgcgtcatcggcaggcttgctcaataaggtgatcgggacgttcaccagtttgtcacctttctgcgcaggcagggatttgaccccgctcagcgagccgaccgtctcaagggattcgacactcttcgattccgccttgaccgcctccaaaacctgggcgatatccgattctgtcagtgccatatcaaacccctccctctatcagttcataaacctggccgtaaccgccggccgtcaggctctcgccgcatacctccttgataagcgtaccctcctcggtggtgatctccaggattccaccgccctggatgatacgctggcacaggacgtaagccttgaacttctcatcacggcctaccggtttgtccttcccgtaattgaacagggcctccgccacggcggtggcgatgttgtcaccgccaagctcgttcccgtcaaagcccctgaatctcctgtttaagtcaactttcatatctctttggttttaaatgtttattcccctgtatagccgactatgatgccgcccctcacgataagtcttattttgtcaaggtcgggattctgggcggcaccatccccccagttcacaccctcgttatacacgtatgtaccgtcggaattgcggctcttgatgtaccggaaccctttcgacgcacaaacatcacttgtcaatccgctaccggtatcccttacatctaccggacccacaaagaacccggcataggtcataccgctggccgggtaggttaaggagcctatcgatgcgtatatagcggccccaccggatgtcgccccgactgattttacgccaaaccgcccactggtagcgccattgaaggccacgtccacgatcccctccgtcgaggaactcgagactcccagtttcaaactccgggaatcgtttccgaaataatcgcggctcttccaatacagacggccggaatcgatggtaaagccgccaatcttaccgccgctcgccttgacagtaccgctgatgttcgcattccgggtctcgatactcccgtccgtgaggaccttgaaatagccgttagccgtaacaagcccctccagtttgatttggtcggctttaatggtaacaccggaaacaagattgccgaactcgtcacgcttgacatagacattcagttccgccttctttacaagcccgttgcttgtaacgccctcagcgaacagcttggaaaaattggcggtagtcaccaacccggatttattccgcaattccccgttctcatcgaaatggacagaaatcagcctgttatatttggccgtcgtgataatggaggatgcctccagcacattgccgtccttatcgaaattcgccgccgcgatcttgatcatcttatccgactggtcaaagaacgtggcatacttgtacgccaaggcatccgtccggtcggtcgagaacaccaacaaggacacttggataatacccgtgaacgacagcttgaagtcgccggtcccgttccactgcccggaatggttgaataccttttccccaccgaccggcaaatcaccgtcgtaagcgaacatgttgaaattctcgtatccgctcttgttggaattgacaaactcgatacgcaggtgcccggcttcgatcaccttgtaatggaaggacaggtagacatagcccgggatacgaagcccgtccccgttcaactccttaaaatcggggatcgtgcgaaaatccccgttcttctgcatgatatagctgttcgttatcctgacgtaagggaccttgccggtctttacgacctccacgtttccgttctcgctcgatgctaacagtttgttaccggcaagaatccacttgccgccgaaagtcaggaacgcggccttgtacccgcttatccatttactcatcccctcggtaaacgtggtgttatcgaaaaagctctgctcctccctcacctcgtcacgcagaccttctacggcggactgtatcttaccctccgtaatttcaaatttcgtcaggatatcctcgccggtcataaggatgaacgtacctttcagatatacgttgtcgccatagagaccgttcccgtgcggctggttattcgccggaaaagcgctgtccttgataccgtcaagattacccacccggcatctcaaacagccgttgaagtttttcgccatcacgccatccagtatgtcaacacgcggctggccgtcctcggtagccgatatgctgatcaggttctgccggagcgggttttccgtgttgcccatcaacacgcactcatcacccgccttcggttccgtcccgccaaactccctctggggtaccgttatcccttccgcgtcgccttccgacacttccacccagtaaccccgaatctctgcccccgtaaaaacggcacagcgcatcaggtcatgcgccacgaacgtgttctcttgctcaaaggtgatgcggtaattgttgccctccttggtcacggtcttgatcttgccgttggccgcggatacaaccaactgcccccttacgctgcgaaccgtttctatgagcaactccagggccaccaacgtctgccggatggtcgccttgtctatcgtaagattactcagccccgttattttatctatccatagctgccagccctcgccgaacataccgtccacgaaacgggtactgcggagcagttcacggatgacagccgtcagaaactcggcgttcccgtcgccgtcaatattgcccccggattcaccggctttgtaatccccaaaataagtccctttcaggaaaccgatcacctcggccgcggtatcccgatgacgtttgctcaggaactccctctggcttcttttcgccgagaaaaggttgttgtccgtgggcagcgtattatcgaagctccggataatatcgggaagcccggaactttcggccttggctttcgtatagctttttagttcccctatgctgtcgtttaccctgtcgaatttcgatacctgcagggcgtcgctgatctccaggtccatctccccgggaaggttcaccttacgcgtgatcttcgtaatgcggctcctgcggtaaccgtctttcgggaaatactcggcactctccaattttacgcgccggccgacaaacagatcggcctcctgccgctcgatccacacatggtcggtcggagccttgtaagccgcgatatccagccagtggtccttgttgtattcgtccaccgcggccgcaaattcctcctctgccagccggtaatacttatccggcatccggatgttccaaaggacataggtgtccccggccttcgggacgagcttgccgcccggaagctgcgtatcatcaccgtaaggccagatcgtgatgatctcaaactcacgggtggcgctatcgaagttcacctcgaaataatggtcgtccccctctcccagcccggaaaggtcaccgctctggaaggagacgcgtttcgtctcaccggccagctcataatcgttcggatcgaaatccatcccgccgtccttgaagtaatagacggtaaaggccttaccctcctcgtccgtcacctcctcactgcggacactgcttaccgtacccacccgccggggatagataccgctgaaggcggcctgttcgtagtggtcatagataccgtactcgtccacgcccacctccacgtacttcttttttccggggagcatcagacgggggctgccgtacttctcggcgtcgatgttccggctgctgccgatcgggaaaaggcgcgtgtagaactttgccgtattgctcgtatcccgctccagggaggtcagccccttgccgtatcccaacgtgatctcctcgccgtgttcgcaacggcacacgttcaccgtctgcccctcgacccaccactctgccttgcctcccaccttgccggcgatctccttcaaggcctggtcgcagtacatgccctcgtagtcgatcacgataaggtcggtaccgtccacctgccccaccttccagtcggtaatgttacccatgccgtcgttgatggccttcaccaccatcgccacatggtcacggggcgtggccgtcaatgtaaacaggggattggtgtcgccgtccgttgtctccagcacgagaaaacgcctgatcaggctctcgataccgtacagcttcaggttatactcccactcgctaccgcttttctctttcggggtgtaccgctccgtcagccagtaccgctcgcccatgtagtccgtgaagtcgcctacatcaagggggatatgggcataatgcgtgaaggagagcgccagcacgttgtcaccctgcacctccttgctctgcgtcgaactgtcacttgcggccacatccgcacgcttggccccggctttatcgtatatcgttaaaagcatattcgaatcgtctttgaatagttatataatcggtaccggctcgcggaacttcaccttgaatttcccggcgtggaccccttcctgccacaaataggtcagcggggtgaacttcgggctgtccgtgtatctcacacgcagtgtcagatcaagctggggaaacgcaatatcaagccacccgtccttccctttcttcaggaaattgatgaacgcgaagtattttttcagccatcccgccttcgtcttgttatacagggcaaagtgcagcgtcacgtcacgcgcctcgttcctcggggtaagcaccgcgctgtatttctccccgtcctcctcccgtatgtccacggccgtctccttcttcgtcttgctcggggtcaggatcgccgagaggttctccatgccaccacgtcggtcctccaccaggaacacgccgtattccgtccaaatgtccgtgccgttcaccagcaccagcccgcccaatatatctgccatgtcatttcacttttagtccgtcacgtatcattttctttatctcatcctttatctcgcccaggtggccggcgctcacaccggtgttctcggctatccgggccaggtggccctcggccgtgtccatcttctccgacacgctctccagccggtcgtccatgctcgaccaatgttgcaaaccgccggtaaacatcccctccagcttcgtgccctggtcatacgtcatggccgtgtagccgcccgctttcgcgctttgactggtgccgccggcttcggtcttgtcgtagcccgtggccgccgccaggttgtcacgcagggcaagggcttcatccatatactgcatgtactcttccatcagcgcgttccgttccgcctcggtcagttcgttgtcctccatggccttgccgaacttctcccaccagcctttcaatttctcgctatacagctcgcctatcttgttactcagcatggctttcataaagtactcggatatatcctccgccgcatccttggcaccgtacttcatgttcatcaggttgtcgatgaagctgctgtacataccatcgaatgaaatgcccgtcagcccttcatacagctggtcggtcagttcctccagcttgccggcctgatctatgtagtcatccagcttctcggtcagtcgcccgccatagccgcccttaccggtattctgtatctgcgtccacatgtccacattgctgcgcagcgccttcatctcctccgggctcaggctccacaggttcccgtcccaccggcggccgatctgtccgctcagtttgtctatctgtgcctggctgaaaccaccccagtagtagttccacgagtggtggcttttgctgtagcgtgcctgttcctgcgctatctgcagatagtttgcattcgtctctttctggtatttgtaagcatcccggtaagcttccaccgatttagtccccttgcttgccttgatggtatcggtcaggtcctcaatggaggtctgcagtttctcgttccggtctgtaaggcggtctatagccgcctgcacttccctggcgtttccgtcgatgccgaacagtttgttgaaacctccgaaagacaccgtgttcagcaatcccccgatacctttcacaagggaaccgcctatctgtttgaacaggtctccgctgaggatattgtcgagtattccggttatcgcattgaaaatggtgtctatcaatgatgagataatcgggccaataccgtctttcagcaaatccagtatggagagaatggccgatatgatctgcccgatgactccggcacttgacagggtctcggacatctgactgatggcatcaccgaccttgcctccgatattcagttttgacagaccggtaagcatattctggattccttcaaatgatccctgcaaggttccgcttgcaaagccgtgcaatccgttggataccatgttcaacccgtcaaccgtgtcccgggaggcacttttcacctccccggcaagcgccttcatttcagaggtggcgttcaggtattcttcgtcagctgaagcactggacgattgggccgtttgaagagcgattttggtacgttctatttctgcctggttaccgctttcaagagccttgttgtaatcggtctgcgccgcttttaaccgggcgaatgccgcttcctgctgcagttccgcattttgcacacgtgttacggcatcccccaaagcgtgcatctgcgtttgtaaccgggcaaaatccaatgtgccgttaccaccgggaagcatgctttgaatacgttcaatggcatcgtagacgacctgctggtctgcggctcccgtttttttgaactcatccgtcttgacatactgtttaagctcgccaagcaggttcttcatctggtctgcaagcaggcctgtcaaatccccgaatgctgctccccagtctatcttttgggtcagagcttccatatccactttatgcacagccgcatcacgctgtttctccaaagtcagcctttcaccctgggactgtgccttgcggattttctcggcatattcttcagcgatggccagtttctgttgctggaaggtcccgtattccttcagatagtcacgcatggcttccgcctcttccctgtacacgtccgcctccgcttttttccgggacgcggtgtttgaggcacgggctttttcaagttcatcctgttgctcccgggtaagtccgttatctccggtggaaagaccggcttccttgttctcacgcttccagtcggcttcctgccggtttatctcttctttccgggcgttatagtcatattcgatttgtgccagtttcttttcggtaccggcttgcatacggtctatctcttccttccggttctcggcctgcagggcggcaagatcctgcgccagcctgcgctctgtggcaagccgttgcttggcttccgcttcctgattcttcccggactgttcggggtcggtatgtccgccgatatttccttttttggctgcttctgccgctttctttacctcttcctccgcttttttcagataaccgtcgcgtttgttttcggcatttttcaacagtatgtcataagcttcctgatcatgtttcttaatggcagcctgtgcgtcatagaactgcccggattctgccatgcttgactgcatgatatattgtccccatttcccgaaaaaacccatggcgctttccgcctcttccggtttctgcgccttgattttattcacctcttcatcggcttctgcagctttttttacaaggttctggacattggcctggtgcagcagaacctgtacatagtcctcgctcttttggataagggtatcataccattcggaaagtgttttataatacccgaaagattccccgtacttgcggttcagttcttctaccttcgccttttcctgttccttgctgccggtgaagttctttatttcatcgatgaccgatttcagttcgaagcgggtacgcaccatctgggcacggccgtccttctctatctcggtcatttccttgagtgatatgttgaattcatccacgccttttttggcactgaacaggtttttcgtccaatcccagatttcatcaccgtacattaccagcagcatgatgccggtggtcatggccgtctgccaggaaaagagcgaggacaggacctgtttccataccggtgtgcctttcttgcctgacttctgcagctcatcatattccttacgggcacgggccagttcgtccgtaaaaatcggcaggttgttggatatggccagaaagaacatctgcggtcccatggccaaagaaggcatttcacgtgccatctgctggatgctgttgtgaagcccgttgaactggcgctgtgcattgggcatgtctgcaggggtgacctgcacggattccgattcctcctgcagcagtttcagtttgccacgcaattcctcaagctgcttctccagtgcatggatctgcgcgatattggcactctggtccagattgggggcagccgtctccccggcaaggcgcagcctttccagttcagcctccagcagtctgacggtattacgcagttccagcgcctcacgctcggccttgttcatgccgggcgtgagtttgtccttcatcaaaaattcaacttctacaggtttgctcattccagtttgctttgaaaaaatcctactatatcgttcgcttcatcctcggcgctgtgttccggtccgggagcaccgtttccgccgccttgctttttccgcacataccgcggtgcgtcgttcagcatcatgatcagcgtctggtaattcacaccgtccagaatgtagtccacactccagcccgttgcactcgctatctgccacacgaagccgaaagggctatgggaaccctcataccgggttcttaactccccttccttgcctggctcagtctcggagtcatcgggttcgcccgcgctgtcgagctgataatacgcataaaatccttcgtgcccatcagacgctcgaatgtccggaacatagccttcagatagcgccactccacaaagttccgcagcacccatgccgtcaccccgatacccacgtgccgcgacacgtagccccggcataccgtataggccagcagacggctcacggccttgccatgctccgccacaaaggccagttcctcggccttgtccttcggttgccagtcgggtttgatacccatcttcagatattccctggccaacaatatctgaccccgcagtctcggacgcttcatcgtcacacgtacctccaccgggcgtttcagccacggaaacttccaccttttaagaggaacggacacgccactgtcaagcagcgcgtccgcacactccatctctatcagttgttccagccggtcagccatacgttagccctcctcgctttggagcgatgctgcagccgcggcttccgccggcggcagcttgtactgcccccactcgtccggtattgcttccgtatcgaacacgccgtaaggctgcgaaccgtcctccggcatcgccacttcgagcgtaacctctatcttggaggtttctgtaagggtcagcttgcctgcaggattggaaagcagcgtggcgttgggaatcagtacgctctgtccggacacgagggagagttcccatggtccctgcatgacaagcacctccgacggggctgtccagccgatcggagttttcttttccgaatcttctttcttataatgcaggctgccgccaagcagtttgtgcaggttcgaatagttcatctggataacgttaaatgtcggggcgatgccgccgttactctgtgggatgaccagcaccggggcaccctgcacctgttcggcctcgatcttcgcggcctcgggtttcttgccgcccaggtcaaacgagttcttttcaatatacccgattgtgaaatccttatactttacggctcctatgccgtacataaaattcttgttcatctttttttcagtttcattgttaataacataccgacaagcaagccggcaaccattccccaagtaaacacccgcaccgggttcggaggacgtttttcctccgtttgaacgtcatttaaaatttcgttcttggtctcgctacggatgcgcgccagctcttcttcataccatagcaccagctgctgcagactgtcacacgaggcttcggccacgatgttcccgctgtcatcgctgcctacggtcagattcgcctgtccactcttcccgcgatacaccgccccttcaggaagtttacggaggctgtccgccggtatagtcagcttcaccgaactcgccggtacccccgccatcaccagtcccgcccgtcgacttccgctcgcgctgtcggcgcttgccgtttccgtccggacttcccggttcatgctctttcggtgactcgcgcaacctgtcaagcacagggcaatcgtcacgatgaggacagttcccggctgtatcaatagcttttctaagacgggccatctcacgtgtattgcgggccagttctttctttgtttcacaaaattcatctttcagaggttttacaatattctccatcaaaatgcgggtggcatgttcggcgttatctatgcgcatagcctctgcaccggcctcggccttcatcgcttccgctttcgcttttctcacagtagcccgcaaggagccaatggtcgccaccgtaccaaccaggccgccgccaaggataatgttcataaattcgctcaagtccataccacccggttttattattgattaatacctatttctttcaaccattcctgcacatcgaaactcggacaggctttcgctgccagttcgttgtgtcctacaatgcgtacatcaggaaatttccggtgaaaatccttcacatacttctccagtgcctttttctgacagccggtgcgggtgtctttcggggtcttaccgtctttttccacgcctccggcatacacgatgtgacggctcacactgttatatcccttggctccgttggtcacttcccaagggtccacctgtgcatcctcattgttttctaccagacgttccacgcctccgttcaggtggaacaggtcggtatagccaacctgcttccatcctcttcctccctgggcaaccggagatgtatgccatttgcggatgtccgcagatgaaacctcacgtccctccggagttgccgtacagtgtattaccagatatttcaactttgccataatcatcatgcttgatagccgctcatcattaccactccggcatcctctttcttgggcatgcagatgaagtaatggcggaagttaatcaggttacgctggttcaacgggtcgttctttgactcggaataatacatcttggtagagcctgttgccttgaaaacccgctgtttgtagaaggcaaacgaacacgggaattcaccggcttctgccgttgcacccaatgcctttttcactccggctgtagtataaagcggattgttgccgtactcatagatttcaaagccgtacaggttgcctaccttgccgctgttgcggtcaatgttgtactgctcgcggaatgcctggctggtcagcagcaggtcattcacatggtcggggcaaagcaccagtctgcggccgtctgacggcacgcgcaggttgtcaagggcacgcttcatttccacaaggtcattcacggtaaggcgcagacggtttgtggccggatctttctcgccggtagtcttaagcaccggggtcgttgccgtattcttgttcgcgcaaagggcatgggccgccttggtgaacttcgcatcattgatactgttggcatgaccttcctttacacgggcggtcttgtcatagctgatggcataaagttcgtcatccgtaatcggcgtggccttggtctggaatttgtcaagcttgatggcgatgtccttgtcttccaaagcctgtacgtcaatcgggtaggtcttgttgttaatcaagacgtccggatccacccctacctctaccagatgaatcacatcgttgttcacgatactgctttggtcgggaattcctgacagccacgtgccttccagcccggcacggagtaccttgacaagctcgcccgtccagatttccgtataaaccccttcacggagtattgaagcgctctgcggagccatgcccatgaaggctgccaccgcattcattcccacagctccggctgcaggagagaatcccagcacggaagcacacacggcacctgtcagcgtattgaacaggagtgccgtcaaaagcattacaatttttcccattgtcttcattttaaaggttttcaaatttcacaggtcattccatattcggccttgtacagacgcttgtactcctccgggttctgctcacgcatttcaagcagtgcgtcactcgggacatcgctcagcttggcataggtggacggctgtgcctgctgcttgccaccctggtaactcagcacggtggagatcttcacctggggttgcatggcatcaagcacattcttcagctcgtcggatccaaccttcttgcccagttcgataaactgtgccttcttgtcttcccccagtcgtttctccgctacggccttttccacaagaccggtaatgcgggccagggtcagcttcccgttttcatctttcagagagtcattctcagccttggccgctttcaggtcattcaatgcccgggttacatcagcctccgtcgccgtttccggcagccccaattgaagggccaaaagtttcagttccatttcttcttctgttttttgattattgattgatggcaagggacattccccgtcccttcccaaagtgatttgtttaccgtctttcatcaatatgatggcatcatcgttagaaccaacgtccaccagagagacctcgtacagtttactcttggtcacggtcggacaagtctgtcccggcagtagatgttcgggctgttcgctcagttccaggatatctatgccggcacttaccattctcaggctgccgaactcaaattgtttcttacacctcttactgaggtcggtcgcctcgtcaaacacgggttcaccggtcacctcgccgtcttccacccggatatccttcacataaccgatcacgctaccgcgctggtgcatgtacagcagtaccggattccgacagtactgctccacactcatgcccgatgtcagcacgcggcttccgtaactgttcaggctgtcatttgaaattcttacacgtttactcatttttccatgccacgcctttgtgcgttggctttgcaatattacggagcactcgcagggccgccaaaaatgtgtgcaacggttgcacacttctatgaaaccgttacacattattttggcggcaaaccgataagcggacaactttgcgaacaaatcgggcaggtgtacagtcattccaatacctgccgttcaaacctatattctttataatatgacaaaggcagaaatcgaaaagaagaaatcgctcgcacgctcactattcctctccggaatggagcaaacggaaatagcggaaaaggtggacgtgtctcgtgtcaccatatccaaatggtgtacctccgaagggtggaaagaagcaagggcggcaaagaacgtcacccggccggaactggtgaacaagcttctgctcaccatcgacacgcttatcacacaagtgaactcgtcggatgaccccacattgatagccgggctgggcgacaagctggcaaaactgtcggcggtcatcgagaagctcgacaagaaggccaatgtggtggatgccatcgaagtgttcatggcattttccaaatggatcgaataccgctcgacgatcgacccggatgtgaccccggaattggtaaaggccatcaacaagtaccaggacctgtacataaccgaacagatgggcataaaataacaagggcatggcaacagcagcggaaaagaaacaggcatacgaacagtggaaagaacactgcaaaagggtacagtccattacggatacggcgctgctcgcaggcgagacaccggcacaaagggacaggcgcattctgcggctgcagggtaactatgccgcattctgcgaatattactttccccacttcctcaccttgcgtgacaagactaccggggaagccatacgcaccattcacaatgcaccgttccacaatgcggcagcggccaaagtaaggggtacgcccaacctgaaggcggtattcatgtggccgcgcggtcatgccaagtccactcacatggacatcttcgtcccattatggctcatgttccaaccaaagcggctcatcaatttcatggtggtggtcggcaaaagcgaagactctgccacacgtctgctgggcgatattcaggcggaactggaacacaaccagcgcatcattgccgacttcggcaagcagcaggggaatgcctcctggcaggatggggagttcaaggctgccaacggggtgaaattcctggcttgcggacgcggacagtctccgcgtggtctgcgcgaccgggaagcacgcccggactacatcgtcatcgatgacttggatgacgacgaactgtgccgcaatgagaaacgggtgcatgacattacagactgggtgaaagaagccctttttggtgcactggatgtgggccggggacgctttatcatggtcgggaacctcatttctaaaaactcggtgctggccaatctcaccaagacaaaaggggtacatgtatccgtcatcaaggcaatagacaagaacggagaaccggtatggcgcgaaaaatggacaaaagaggaggcgcaggaatacagggatttcgtaggctaccgggcatgggaaaaggagatgatgcacaaccccatcgtggacggcactatcttccgggcagactggattcgttacaagaaactgcccagactgtccaagtatgaaatgctggtctgctataccgacccctctttcaaatcgaccacttcaaacgactacaaggcttgccgcctttggggcaagattgggaaggaactgcaccttatagactgttacgtccggcaggataccgtttccggaatggtacggtggctttacgacctctacgagcgtacacgcgatacggcagccgtccagttctttatggaagcgaacttcatgcaggatgtcattctggatgagtttgaggcagaaggaaatctgcgtggataccaactgcccatcatgccggacaaacgaaagaagccggacaagctccagcgcatcgaagcggtgtcaccattatgggaacgcggtttcgtattctacaatgagaagttgaaagaatcgccggatatgcagaccggaatcgaacagaccttggctctggagcgtggcagccgtattcacgatgatgcaccggatgccgacgagggagccatctggatgctgcagcgcaattcaagacaggagagttttcaaccggtgttcggcaaaaggccgaccgccaaaaatatatggtaacatgatacaactgattaaaagaatgatttttgcatggcgctataaacgtgccgttgcccgtgcttgcaagtatgccaagctctacggaagaaaatactacgtcctgtatatgggcggcaaactgaaagttgtccccaaaaggaatatctgcgaactgattcaccgccaccgtttccgcaagggaaccactatccgggatatagaaaaaatggcattattcatcactaaataataaggtcatgttcattacagaagaagattacaaagttgtcatcggcgacaacgcattgaaggtcatctcccaggtaagcccggaaaaccgtaccaatgcagaagcggaagcccgggaagaaattgccggttatctacggccgaaatacgactgtacggccattttctctgcacaggatgaacaccggaaccggctcattgtcatgtacacctgcgacatttcactttaccacatgagcgcagccatgccacaaaagatgggaagcgagatacgcaaggaacgatatgaacgggccatcaagtggcttgaaggcgtacaggccggaaaaattgtccctgatttgcccttggctgtcggagaagatgggcttccgtccggaaattcacttgtttacagctgtcagaagcagcttcatcataactggtaggactatggatattaaagactttttcagcggtatgttttccagtaaaccgaaaaacgtactgcaaacgccatacggcaattttaatctggccaaggggaaagacatcaagcgggtgcagaaaatggtcatcgacctgcagcgcaccaccgatgcactcacccggaaggacatcaagaactggcgcgatgcctggcagtcggccatcaatgtggacagccccagccgccagcgcctgtacgacatctaccgggacgcggaaatagatcttcacctctccggatgcgtggagcagcgcagagggtttgtcatggcacgctctttcaaaatcgtagacgtgaaaggggatgagaacgaggaggcggtacacttcttcgaccaatcctggttcaaacagctcatgcgatatgcgctcgattccatctactggggacattcgctcatcgaattgggcgacctttgcactgacggcgacggctgcatctgttattcggatgtgaagcttattccgcgtaagcatgtcattcctgaatatgggcgtgtcataaccgacctcggacaggactggactacaggtatagactaccgccagccgcctttttcggactggctcattgaggccggcagacctgacgacctcgggctgtatctcaaggcagcttcacagactatccccaaaaagaatatgctggctttttgggataccttcggggaaatattcggaatgcccatgcgtatagcacgcaccacctcgcgcgaccagaaagaaatcgaccgccttgacaagatgctgcgtgaagccggaaccgctctctccatggtggcaggaatggaaaccgaaatcgaatttgtggaaagcggcaagggagatgcattcaatgtctatgacaagcgcatcgatcgggccaattccgaactgtcaaagcttatcatcggacaaacgatgaccattgaggacggaagcagcctctcacagtctgaaacgcaccttgaagtgttccagaacctcgtggaaagtgactgcgacatgctgcgggatatagtgaacaaccaactcattccgcgcatggttcgtcacggttttcctgtcaagggactgcgttttgattgggactactccattgactacactcccgaacagcagaaagcctacgaagaaatggtactgcagcactacaaggtgaagccacagtactttgaggaaaaatacggcattccgtgcgaggagaaggaaccgaaggaagagccggacccggcagatccgaaaaagaagaaagacgacaaacaggctggaacgctatcccgttttttcgactgagccccgaggattattcggggctgcatctacgctacagttcattgcttggcaatcataccctccaactctcaaaagaggacgaggcaaaattgatgcgtgacaagcttacagagatgttcgaccgcatgatgaaagccctgttccgggagcagggggcaaaccttgaaatcaacatactggcttcagaagaggcgcaggactttatagagacgcacgcctccgtcctggactcttcattccggcaggtggagatgtccgaggccatgcgagggcgcctgcagaggtcggattatatattctcaggcctaaagacgttccatgaactgaacgaagccttcccctccctgctggatgagaacggcaatcgaaaaacgttcgaacgctttttgaacgatgtccggaagatagacgaaacctataatcggggctacctccgggcagagtacaactttgtgcaggcttcggcgactatggccgccaagtgggaacggttcgcagaagacggggaccgctacaacctccagtaccggacggccggggatggcaaggttcgcccggaacatgccgaactgcatggggtaacacgacctatggcagaccccttttgggaagagtatttcccgccaaatggatggaactgcaggtgcaccgtagtccaggtacgaaaatccaaatatccggaaacgccctacgatgaggcaatggcattgggcgagtcagcccttcaaagggacaccaaaggcatcttccggttcaacccgggaaaagaacagaagaccatgccggattacaacccatacaccatcaaaaggtgcagggattgtgatatggccaaagggaaacttaaactggccttcgttccggacaacgagctgtgcgccgcctgcaaaatactgcaaaaatgcgccggagaccgggaaaagtccgcacgagctatcgaacgtatccattatctgcatgaaatggagcctctacttcaaaagaaagtggaaaagaacataaatggcaaggacttgaatatcggctttaccaaagagggcaacaagcacttgttctccgacacattcggacggacacgcatcgtttccaaggaggacttgaagaacctggattcacaccttgaacgtgccgaatatgtggatgattccgcattgactcacccaaggacggacaatgtggaacacttcttctacttcaaagttaaaatcaatggaaaatgggtaaggcttaatgttgccaaagaagtaacaagaagggataacggttatatccgcataaaatactttttatactcagtaaatgatataatagtagaataaaaaaaaacaaaagcaccaagggcgacactttggactaaaacgcctgctcgtcattccctcaatgcttctgtgtttgcaaatatacaaaacattttttaatccaattgcttatgaacaagattctttcatttttgaaacaaagtaaccgctacaaacacctggtaggcggttttatcgtggggctgccagccctgacaccgtacgcggccttatacgcagccgccatcgcagcctcctcgctggagctcaaagacaagctccggggcggtcgttgggactggacggactggacactcaccgtgaccggaggagcaatcgccgcattgattttcctcgttatctaacaaggggactggcttttatccgtacctttgcaccccggtggagcttcctgatagtccgtgtggtctatcgcgggtacaacaatgcgaatgcgaatggcggcgtgtcgaatgcgaatgcgaataacgatgcatcgaactcgaacacgaatgtcggctcccgtctggaaatctaacaatcggcgtacaacaccggggacgtgtcccctaccgtggtgccgagggaagcaagccacagcaaaagcgcacaggtgcggaaagctgaaaaatcacgcgtcgggtggagtttggtaggctcaagtcagctcgaagaagtcagacccggggaaaggaaggcccttatcttccgtttgtaaaacaatcaaaaaaaacgatgctataatgcacaggcaaggatatatagtggaagagattgccgattattccaatatggcggaatcgttcaaccaggtcctccgtggctccaaacgaaaaaaaagccgccagggacgttacctgcttgcgcacagggaagaggtgcttcaggaacttaccggaaaaatcaagacgggtacattcaccgtcaaggattaccgggagagggaaatcgtggagggtggaaaaatgcgacgtatccagatactcaccatgaaggaccgcatcgccgtccacgcaatcatggccgtagtggacaggcacctgaagaaacggttcatccgtaccacctcagccagcatcaagaaccgcggcatgcacgacctcatggagtacatacgccgcgacatgaaagaagacccggaaggaacacgctactgctacaaattcgacatctccaagttctatgagagcgtggggcaggatttcgtaatgtattgtgtccggagggtattcaaggacaagaaactcatcgccatgcttgacaacttcgtaaggctcatgccgcaaggaatcagcatcgggctgaggtcgtcgcaagggttgggcaacctgctcctgtctgtttttttagaccattatttgaaggacaagtacggcgtccgccatttctaccgctattgcgatgacggcgtggtactcggtgacgcgaaatcagaattgtggaagattcgtgatgccgtccacttccaggtcacacaaatcgggcttaccgtaaagcctaatgaacgtgtattcccggtggacgagggcatagacttcttgggatatgtcatataccccgaccatgtgcgcctacgcaagcgcatcaaacagaagttcgcccgaaaaatgcacgaggtcaaatcgaggaaaagaaggcgtgaactggtcgcttccttctatgggatggccaagcacgccgactgcaatatgttgtttaataaattaacaggcaaaaaaatgagatcatttaaagacttgaacgtttcctacaagccggaagacggcaagaaacgttttcccggctccgtggtaagcatccgggaattagtgaacttacccatcatcgtgaaggacttcgagaccggcatccgcaccgaacaaggcgaggaccgctgtatcgtagccatcgagatgaatggcgaggccaagaagttcttcaccaactcggaagagatgaagaacatcctcgcgcaagtgagtgaaatgccggacggatttccgtttgagaccatcattcggacggaaactttcggcaaaggtagaaccaagtatgtattcagctgatgaaaaaagtggaaggaaacatcggggtacggttgcttgaatgcataaaccccattaaaaacaaatggcgtgtccgatgggacgtgcagccgggagagaacggatcggccacctacatggaagaggagttcgaccatcgacccaccgaagacgagatacgctccacggtcataacatggcacaaccgggaaaccgacaaggatatcctatcaggtttcacctacgagaatgtcccggtatggttgtcaagcgagaaccagttcaactacaaggcagcctacgaccttgccgtgcaaacagcaggggcgactcttccggtcgtgttcaaattcgggacggacaccgaaccggtctatcgcgagtttgctacactggaagacctgacagacttctatacgaaagccatgcagcatatccaaaacacgctggccgacggatggaaaaagaaagatgtatttgatttgtcgctatatgcggtagattaaaaaaagccttcgggggtaaggctgtaaaaaaagcccccggcctgttaaaacagtcgtctcacttactattaaacacaacgcacccaaatggagcgcggccgggggcaatgccctcatgccaccccatttgggtgttttcgttgttgtttaataagtgagacagtgcaaaagtactaatttttgttgaatatgaaagtaattgagatactgaaattgaataaaggaatgctgaaaacatgccggaaagtgggaatccggatggaagacgtacagtatatcgaactatacaatgactacaacaggctgttggacgaaggcgaaaaggtttcctacatcgtggcagtactggccgaacgttataatgtttgcgagcgaaaggtatacacgctcatcaaacggctgcaaagcgactgtaacccgtttgcagtgtaatgggacagcctccccattgaagagggataacggcgcggtacctttgcagggtatcaaaacgacacaccatgaacaagtattatcaaatcctgaaaaaggtacttgccgacggcaagacacaaaaaggcagaaaaggcgaaagccgttacctactgaacgagacggtaacgctgtcccctgcggaactgctcgatattttcgagggacacaatatcgcacggaaaaagctcagaagcgaactgtcgctcttcatgagcggggaaagacaggttgagaaataccgggaagccgggataaactggtgggactactgcggctccatcctcgtgaactcctaccctacctatttcgagaagctgccacctctgattggcaaaatcaaccgggaaaaacgaagcagcaagaactacgtgctgttcctcggttcgaccggcacggaaagcaaccaggcaccatgcctcagcctcgtacagttccagatcgaacaaggcgaactggtcctgacggcctaccagcgtagctcggacgccaacctcggattaccggcggacatctatcacctgtaccttatatcccggcaaatagaactacccctgaaatccatcacaatcaacctcggcaacgtgcatatttacgagaacaacgtcacacgcacacaagaactgcttgccggaaatcctaacgtaaaattcgaattgaacgtatgaaaaagacgtatctgtcagccccgctgccattcgtgggccaaaagcgcatgttcgcacgcaagtttatgaaagtattggaacaatatccggaaagcacggtattcgttgaccttttcggcggttccggcctgttatcacacatcaccaaacgatgcaagccggaagccacggtcatatacaacgatttcgacaattaccacaagcggttggaaaacatcccaaggacaaaccggctgatcgccgacctgcgtgccatggtagggaattccgttccacggcacaagaccataaccggagaactgcgtgagcgcatcttcagccgtatcctccaagaggagcacgagaccggttacgtggacttcatcaccctgtcctcctctttgatgttctccatgaaatataaactgaacgtaccggagatgcggaaggaagccctttataacaacatccggaaagcggactatccggagtgcacggattatctggaggggctggaaatcgtctcctgcgattacaaggagctgttcaaccggtacaaaaacacgccgggcgtggtgttcctggtggacccgccgtacctttccaccgacgtgggtacttacaatatgagttggcgtatgtcggattacctcgacgtgctgaacgtgctatccgggcatccgttcgtctatttcacctcaaacaaatcctccatcctggagctgtgcgaatggatcgggaaaaacaaaaacatcggcaacccgttcgagggatgtacccggatggagttcaacgcccacataaactacagctcatcctacacggacatgatgctgttcaaaaaagaggctgcctgacggcgtttctttgccccctgttgaaatagaaagcctccggcggtaatttgtccgccggaggctttactgtccgaacatggccgtttatcgaagccgtttgaaggccacgcacgaatacacctcgatattttccacgatctcctcgtggttgtggttcgtctggctctccacaaggtcaaatgccatgaaagtatcgccatccatgcacgagagccgctcatgtatcagttccggcaggtcaaacacctccaacgcctcttccttgaacggactgccctcgttggctgcaccggcccagtccgtcacgatatgcagtttcacttccggttcggcccgatattccaccccgtccacaatcgcgttccagcgtatcgggcagaactccacgaacacggcagggcgttcccaattctcctcctgctcgataaactccacattgtggttccacaggtcgatgtgttttatcaagcctccgcccacctccttcagctccttgcagagcatattataaagttcctttctcatttccgtcttatgtcaaattcaacattgaaatattccgttatattttcctctatgatttcacggacagccttctccacttcgggagaaacccccaagaaacgccttcggggaatcttgatcatgctgccctcctttttcaaggccatgaacttccagaactccgcctcgccggtcaactgcacggtacgtttgtccttgcgtttctctccattcttcctgcgtccgaaagaaccggtcgcctcgtagtatttatgccaaaagtaacgcttcatcttttttgtcacccttatctccccgccgtcattgtgaatggccgcatacgaaaggtcggtgtaaaacgtgatgctgttctccgtggtccggctggaaacgctccgcctgagccggccggtatctatcaaaatagaacctccgggacgtgtcgggcttttacgccgctgccatgcctcggagaaaaaagcctgacgctcaaaattacggtcgaactcatctgtcatctccacccggatatcctgcaggatccgggcgattatcttctgcacgtccttgttcatagtcatcgtcattaaagagtaaaagctggcgggtctcctcgtcagctatcttcttgctcgcatccgcgctcgcgttgagtatattgtagaatgtacgttcggtaacggcatatacaggatatacgtaccgccgccagatctcgcggttcggtacaccgcgtttggcatattggtcgtatatcctgtttatctcctccacacgtttctcataacttactccgcgtcgctttgccatcgcttactccttctttggattatatggttgaatatccagttccatcttcgcgctcactatcacccggccgctgccgccacactggggacaagcctcctcggtaatattcactttcttttttctgaaaatccgggaaggaagttcggtcgttctctgtacgacacccgtgccgcgacaagcacggcacaaggctactttggggctcttctctacattctgtatcatactcttcatttttaggattctgtcatacccaacgggatgggcttccacatcccgttattgtctcttatctcagctctgatgaactgcttgctcacctccggctggtaactctcctcgatgatgcgcacgccttccatgaaacgctcgtcaccggtttccatcgctaccttgcgcaattgaacgatgcgcgaggctttcaacgtacctttggcatcacgtgccaacaggcggagaaccatgctcaccagcgccttggtcttttcgtccttggcgaggctttcgatatactccttcacaatggcaattccgtcctccaccgtatcgcggtaaccgtctgtcacatacacgcccaacgtgatacgcttgcttccctcgctgttggtgaatgtgtgactgcgctgatcgtcctttgctttcgtcttgaacaggtcggacttcatttcaaggatggtcttgaaattctccatcaccgtccgcttgctctccttgatgcgctcgctgatacccagcaacaccggaatagagcgttcgatctcctcgtccaccatctgcttatacatctcgcggtcggctctcgccttctcttccgcgactttcttggctttcgcctgacggaaggcatcaaactccgccttctcggtttccgtcattacgacggtctggttcttctcttccataattcaaatcgtttttgttgttaatccatcaattctcatactcctcaccataatctggcgtttccaactcgctttccaacagggcttcctcatatttctcataagaccactcgttcagcctgttgaaaaactcttcccgatcatcccggtccatttccgggaacacgtcaagtatctggttcttgacattctcaagcagttcattaaatctcttatccatatccgtcaatttttaggggctttggtgtctatgagcatataggtcaccgccgccggttgttttacttcctctttctttttttccttgagcccgcccttgcgccggatagagcgcagctttacagccagttgttccagttcgtccgaagagatttgactgaacgcctttcccgcaatccggggattccggcagaagtcattgacacgcgcccagtccgaagtgtcgattcccattttttgcatgagtctcaaacacacgctgcgccaatatttaagttcctcctgcatcttctgacgacgctcgtccacaccggccaatttctccaatccctcacaacaggtcttatattcaagcctcgtcatttcacgaagactgtctgtccggttccatgtatactgcaacacgatggacttcttgaactcttcccggtctccgttgaacggcagcttgttgaacaaagcgtaaaaccgggcgaaattggttacttcctgtgccatatcatcctttcacttttttctccaccgaaaggatagccagacttatcatcataagttttacagactgactgtcctcctcaagcaaatcaatatccgcaaccacaggctcaccgctcatggcattccatacttgctctacctcttccgtcttcttttggttcatcaaaaagagatacgcatcatactcggaacgatcaaactcaaatacgacctgaactttctgtttttcttccatagttcctatcatttattgttttctttcttcgttacttcatatcctttttctttaagatacgttgccacataatcatcattgccaaggtcattcagcacatcaaaaagataacttgacacataccctgcaacggcatgtgccgatgcataatcaattttttcagagataaactccaccttcttggttctacccaatcctcgaaatgctttttcaatgtcattcataattctatattttaaactgttattcaaacaatactttaatgccgcatgaactcgccacgtcaagttccagcttcgcgcctttactcagttcccagtccttcagcatatagatatactcacaatccagaagcagggcgatatccgcccgcatgtgctctctccaatgggcctcatccggcagcccgttcttaaaaggattgaccggggaaaagcccatatttctcaaattctgttccgcattggcaaacgcacccttgcgctcgtcaatgttatagtgggctattgccccgctgatgtaaaccttgtctttttccatatcacaaattattactcgtttgaatgattccttcttcccacaccacataatagctgccggcctcaccgatggcacggccttgacaatacgccttataaccgaccacccggatcttcatgtcgcagatataacgcaaacggatcgcaccgcctcccatcggctggctcttcttttcctggctgatccagatgaagcactttttcggaaaacgcttcatcaaggctaccgcatccggatactcccattccgacacctgatacgaatccacgatgataaacttcggggatttcggcttctttaatcggtctatcagttcctcataggtctcgtccacaaccacacggaacttaccttgcacctcgttcatcttcaaatattccatacggcgttggaatgtctggttcacgccctcttcataactcaagtacaacacaaggccgtatttgcacagttccttgctaagctgcatcacaaagctgctctttccgctggcactggcaccgctgatgaaccaggaggcattctccgcagggaacccgaaaggcttgttccatttctcgccccacggcaacgtcacccatttcttggcggctatgtctttcggactatatgctcgtttcatgactctttttctattgattcaatcctatatttcagaaaccctttgatgatatgcggaggatggtgtatcgggcagaattgccctacgtaaagcccccaatacgggacataagcatctttccatatttcattttgaaatggtccggcttcctccacaagaccaccttcatttactttgagccataacaggtcttggcctttgtcctctaaaactatcttaaccatttcctatgccattttaagtttctctatctcggtatatactcgcctcagacctccacgtgtcttgcgtacaatctgcgctatatccgcacctgccggggcatttactttagccaccgtctgagcttgggcattcaaaaacgcctcacgctccttgccgtcatcaggtgtcaccttgctgtaacggtctccataacggctcaacatctcggtatagcccactttcttacattctatcgaacggttgatcttttctttcaaaccatccgcacccatcatataccaggcacaactgcgttcggtggcattccacaaagccttcagctcaaggaacgcctcatactgcaaatccccggcctcgtccaaaataataagcggattctcaatggaacggaggtaataagtcaaatcctcgtatacatcgctatatttacctttggcatccactccgaactccgcagctatcttacgcaccagcttcagcttagtcttcacctgcgagcagtcgatatacacggcattcttgtggttctgcacataataccttgcggtaaaagtttttccgatgtttggaatgtcgcataggatagccgacaggctcgactgctgggagaactccagctgggcggttatatactcgaacgtggcggtcttggcaaccttccactccatatcggcacggaggctcacacccaaacgacgggctatacttatccagttggcatcactaagagccttgtccgtctgtccgttcttaatggcactgtacaccgatgtgctgatgccaagggaagcggcgtgtttggcgtcactcggatagttcgcacggttggcggctaccgctcccaaaatcttctgtttttgcgcttctgtaatcataattcaaacgctgttataatgttattctaatcgtattcttacatatctccaatagccattgccgccatattggtcggctgccattcgtaagcttcatcgggttcttcaggaacaggtgccgtaggtaatacaaggctttccgtttcctcatcttcttcctcacgttggaccggtgccacacctacctgaccgatagcgttatcacgtacccatttgtcaaagtgactcattatctttgcctgttccgtataagctgccttatcttcttcggtctgttccgccattacacggctataagtcacaaccgggcgcaccttgtcgatgtagcggtcattctgatacaggaacacatcagtcggtttgccttcctcatccggcaaatagaaagccgtcaccttgcggttattaggctccaacttctcaagaacctccggaccgctcagccaccagtcagcgtacgccacacgtaccgtactgttccgtctcacgcttgtttccaccctctcgccgatataacggctcagggtcagtttgtcaagcgggcgcagagtcgggttgatcctcgccacaagcacgtcccagcgggtcatgcccggatatttcttctggttggggtgcagcgtgttgttccattcagcacaatccctgcggtcatctgccacaagttcctcaaacgtataatatttcctatcctcgtaggtatggttcccactgtcgctgattttcttctgatccacacgccgtgcccctttaccgtaccaacgacccaccccttcatggttcttatgggcgatggtagtcttgaacgcaccgttcaacggctcagcatatttgtcctgagagttcaacggtgcacaaaaacgcacaaacttgaacacctcaccggctttcaggaagccctccttgtacttgctcatcaaatgctgctccacctcgataccggcaggcatcccccacccgttacgctcaatcaggcggaacatatcccggaaacaggcaaccacaagggcttcgtctttatcacggccgtaagcaagccccacacggcactggcttaccacatcgtaggcataataagcatgtacgtattcaccacccttcatgcgacgcggaagatccacgtcatccatcgtaatctgggacaaggagaactctccactgtggcggtgcatgtgtggcatttgctcgtggtagaattccgaccacccacgacgttttttctctatgagtacctggttggccggcttgttcaagatgttgcgaatggtactttcgctcagttctttcggatcaccgttcttatccgtaaaatcgttatggttgaatatttccccggtttccaaatcccatacctccaactcaccgcacacaaaggagatatacatctcgtgtacgtcactgccataaggctggttcggcagcaccgtgatgctcagcacgagacgctcggtcttgtaatccactttcctcgcacactggttaccgaactttccactgataaggcactcataaccgtactgcttgtactcgttcaccttctttcggaaacgcaaggtactcgccggcagatcatgcccgaactcttcgcgcagcgtctcaatggtagtagccatcatgctccaatcatacttctctcccattaactttcgataatcacgactacgattgtacaacttgatacaagtattcagtactgaagcatttatcgcatactttctggcaagctcgtcagaagccttatcgctggactgccgggcagcccaatccataaagaaagcgacggcagcctgatcaagctcgtaattcgatattatccagccacgcaaaagcacggcattgccaccaggatatttctcctcgactttttctttgtaagaggtaggcagactatcaataacaatcaaagctccatttcctttcgctccaccaccacgacgtgctacctttatccggccactggatgccatatacttgtaattcggaacagtcattattccgccatcaacaagttcacgaaacgatatgcaaagtttgttatcgaaaaattccatactcacacctccttatttcaatgcggccgcaaaattttggatgctgtctatattggaaaatgtcacattatcataatgtctcacctcttcccctttataagtcaccacacccgtgctgtcgtttttactgatctctaacaatgcgccgttcggaaaatattggcgtatcacgttatcatggtcgtgtagtgtctccataaccggagccaccgccattacaataccaccacgctcacgggcggccttctggatcctacggatggtatccgtatcctgttcaaaacgcagggctttccaaaccgtcacgctgcttacgttgaaagccttggccaaaaactggcgatcctcacttgttacatgaatatacttcttcatatctcacttgattttaatatcctaattcgttatatttgttgcgttttaaaaaaataaccgacttatgcctcaaaatccgacatcactgcctttcttggtatcttacgctgatactctctcatcagcgaagagcagacctctaatccaaacagccctgacagcgattgcatctcttcaagaaattgactgcgtgtgtatcgacaacataacgctacctgacgatattgcagaagccggcgctcgacttggagcatacacgacagctgatcttgtctggttccacttctcaaagcattcactaatgacgcaaaaggtgttcgagaaagccgttcgcggactctttgctcatagtcagttgggaagcccggtatgggtgtttcttctgccggagaaataccgacatctttacccttctccatggaattgattgttcttttcataagtcactcattttagtgtctatatcagagggagtccaaggaatcgaaccctggcgcaagaaccatacactcccgtgtgtctttccacaccgccacccgtctcttaacgccttccgggttgtcacgctcggttttccgttatccttcaacactttcacctttctctataacttcaagaagcattataaacttctcacgtacagactgcttcatctccagttctaatgtatgcgccagatttgaagctgcactggtactgttcctgcgaatgcttccggaaagaagactgtcagtcaaactgcttatcttgttttctataaacaactttgcttcctcatgactgccaacggataaaaccgttttcaaagcgcggtaacaagcaagctctcgttgtgttttgtacatctcttcagcataccagcaaaagaagtgttcatagtcctcgttcatctctttggtgtacttgtcagcttgttgtaccaaagcgtctatatggttcttcacaaaactgaatacaaaatcccagcaatccattttcttattttccataatctcacttatttaaattcgtttataatcggtttcaaactcacgccgtagcagctcatcaagcgccggatgagattctttacataaaaatcgggagcggaaaacacaatcccggtctcttcagtgtatctgaaactgataccgtccatcatcaacacgtaagctactttgtgcttcacgctttgtgtctgccattctttgatttcttcgttcattttctttaagtgctaaaattcgttattctcgacctttttttgtatctttggtcgctcgttaatttcttaactcgatgcaaatataatacgcatttgcgaataaacaaagttttaagagttaaattattcgcatttgcgaaaaataaattcaatgatgagtataaacgaacgtttaaagaccattatcgaagaacaatataatggcaataaaagagccttttctatggcgataggagtaacacctactgtcattgaaaatgtagttggtagccgtcaaggaaagccttcatttgatgtacttgaaaaaatatgcgcaaatgcgaacatttcacctgattggttattaatgaataggggaaagatgctttacacatccccacaagacagttctgttaccaccaaaagccaggtagcttctgccaatttatctccagatatgctcacagagcttctcaaccgtatcacagaacaagcagctgaaataggccgtctcaaagaacaaattcgccaaatgaatcttgaaaaagggaaacctgcatcggatgcgtacacttctgggaatgcaaatgtagggtagagcgtacttttaccatccggagaacatgaaacgttaccctgtgggtacccccgattataccttcagactcccctctctcggtattccccctccatccaccccatataatcgccccaaaaggactgataatccgttatataataatgtatactttttataggtgatggtttttagggtgggtgtatcaaggcatattttacacctatcattcaaaaaaccatattttaccatacttccaactaccccctctcaaaaccgtgtttactaaccccagttcttataaaaactaaccccactttctaaccccagtactatccccacctccaaaattgccactccaagtgttaggacaatcatcacttcactcgccactttgagacacaaaaaaggagaccataagtctcctctacaagaataactgccgaatggtgattttctttcgttctaatgccattctaatctattcacctactctcccctcctactccctgaaataagcgtagattgcttgattatagcccttttagtgcatactgtaccattaccggacagaccggcatgtaacaaataattcttggtcgcacccacctgttctgccgtcaaaaccgtataaacagccgaaatactactaaaataccaatctcttcgctttgttccgtctattccgtgcgtcaaatgcacatgtataacctttgccatatcaatatattttgcggagcaaatataccaaataatcattatatggaatattttagaaacatataatccaaaacaaggcataaaaaaagcggcatataaccgctatcttcctatcctacttacacaccatgtaaacctcatgtaagctcatttaaagcaatcgccaaacctatgcagccgaaacagccctccacgtaaacagaaattaaacctgcgtaaacgtttcgttttgcgggagttccttctatctttccccgtaacctattgtattataaagcgatgtgtcgttttattcaatatatcgttttatacgcttcgttctgtgccccgtatttgcagcttatattgcgtcgatagcaaattaatgcataaaattttaaattatagcaaaaataggttatccaaatacagcaattgccgcatttggataaatttatgatagcaaattaatagattatctatttttatgcaattcctgcactttgtttctatactgagcgggagtcataccagtagccgcctgaaactggctataaaaagtagtcatggaattaaagcccaattcagctgaaatcgcctttagcggagtttggttatcaggatcggaaagtaaacggactgcctcttttgtgcggaaaccatttacaaattgagtaaaagtctgcttggtctgctcattaataatttgagagagataagtacgattagttcccaacatttccgctactttctctttggtcagcaaattgtctgtaaataccttctcctcccacaacagcgtttccaaacgcagaaataaatcctgcttcttttcatctgtcaacgaggatgaagcatatttctcaggttgcggcaaagaagttttcgtcgaatccgtaagatattcttgtaaaagagcggactggcggcctatctctgcaaactgctcatctatcttgttctgcaattgctgttcacgccggatagcgtcctgattttgcttcacaatggtaaggtacagcttattttttctgtaatataagtaatatagtaaagaggcagctatgaagatacagataaatccggctataagcaattgcatcttattttccttttccaataattccagacggttttgttttatctcgttttcctgccgttccatatcgtattttgcacgtatctcccccacagcacgttccttttccgcattatataagctatctgtttccagctgatagagcttatgatacttcaacgcctctaccagcataccatcttcttcataacatcgggataaagccttcaacaggtcacttcgatagatggcattagcctgttggtaagacagttctattccggctttcagcatccagacagcccggtcatactggtgatgctccattaaaatttcggcatagcccaaataagaattcatcactgaagaaatatttccctgttctttcaaatccaaagccttccggaaaaaaaccagcgcttcatcatctttattcaatttatgcagaatatatccataaagattgtaaacgtttgattgatcataaaagtcattctgcaccatggtgaactccgcctcctgaatatatttcaatgctgtattatagtcactcttcaaataatacatataagcggtattggttgaaccactataaatcagataaggatctttccgttcatgtcccagttcataacattcaagagcatatttcaatcctgtgctatcatttttcaaataataaataccggcaatattagaaagcaaaatggaatagagcctgtcataatgacaacgtcttgcagcttcaactcctttgaagaaataggtaagtgaacgataatagtctttttggacattcgatgcataaagtcccagcccattatatacggaacataaggcggaatcatttttattactttcacctatcagcctggcctgccctaaatgactataagcctcctttacatttcccttcatcatatgggcctgccccagacaaatatgagaataaattacagcgccattgtaatcccgttcattataacccaactcaaacaattgtcgaccataaaagatagcctgatcataatctgctttattcagatagagaaaactaactttccgaagtgcttctttgtctttaggatactttttcagatactccaactgtacattaatggcattatttatttcttcttgcgcctctgaaacaacgggcaagagtcccaataacattacaaccatccacagtttgaacatcttcattcccgtcatcctcccttttcttctttccgcatactgaactcacagccacaatattgctgattataaaaattatattccttaatgatagcaatgcgacgctcgctcaatccacctttacgccagttctgttcccaataagtgacatccggataaggagccgtagcatatcggcccgcttcctctatctgttccaaacttttccaacggctggaagcaagcgtagtagtgataaccgggaatccatgttcgtgggcataacgtgcggtttcctgcagtcgcatcttgaaacaacgcaagcaacggcctcctctttcaggctcttgctccattcctgccattcgacaacgccaggcatcatgatcataatcggcatctataatttccaatcccaaggactgggcataccgcgtacattcgtccttgcggataatgtattcctccaacggataaatattgggattacaataatagataaccggagtgacaccatgctgcatcaagcactctatgatggctgatgaacaaggagcacaacaagtatgaagcaacactttgtcggctcctcccggaacttcaagctggaatttctttttcatacggcaaatttaatagatatttgccatactgaccaacggttcgtataatttttctatatcctgcgcatccatttctatctccacttgatcaccgggaaccagggtttgcccctgaggaagtaagtttttacgattccggtgtatactacgaatgatacaatgattaggtaaagccaatgtatccacttcctttccgtcaaaataagacccatccattatctcgacaaaaagatgatagcgggcaccagccccttcggaagacttcggattatggctacggaacatcctgtcatacagcaatacattgtaaggttttatctgtaacaattcggtgaaataataagtcaacccacctaccacgatggaaggatagaacacctcgaaatgaccggtaatctccgttatcaggacaatggcagtcaaaggggtacgcaccacagccaccaaaaaagccaccatcccgatcagcatcatataactcacattctcataccctatccatccgcgctgtaccaataccaacccgaagatttgtcccaataatcctcccgtaaccaaggtaggaatgaaacttcctcccggcaaacccgaagaaagagaaaacagcgtaaaaacaaaatgaataagcatcatgatagtaagccaccggatatcatgagttccattcattccctgcatcatcaaaaactgctctccgccacctgtcagattcgtctctgttaacgatatggcataagctatgatcaataaatacaacatcttgacaggaatggagagtttcatggcaggtatcctttcttgaaagaaaggaacgatgagcgaataaaactttgcaatgacagccataagggcggcaaagataatataaagctctgcctgacggataaaagataaaccgggaacgaccgcactaatcagatgataaggagtcgtggggaacatccaactagccactcctccggctaccacgccggccaacaaggtagtaatggcggttttaggcgcatcaaaacgctcgatggattctattaccagcaaagaagaagacaacggagcggcaaaagcggcagacaagcccgcaccggctccggcagccagcaattgtttccgttcccctttcaggatatgtccccaacgggagataagtgttcctatataagaccctatctgaacagacggcccctcgcgtcccaaggacagccccgcactgagagccaacacacctccgcagaatttggccaccagttccttaaaaggatgctcataacggatacgaccgttattggccgcacgtgtctgaggaataccgcctccggctatcaatggcatacgttttaccaaagaagcgacaaagatcagaatcccccataagataaaaaacaacaatacatgccaataccacggataatgcgccgtgaaaaaagttttccgcacatcaaagaaataccagagaagatagtgataaggcacagcaaccagtcccgtaagcagccccacgaatatgctcacgaaatacagacgggcatcaatcagcttcagtttccatatttgccatttgcgcagattgctccactccttccacttgtttttccatttctccagtttcatatccggaataaacaaatggaaaagagaagggtttatttaaacaatggctttaatagttccggtatttctatttcatttgctttcagcgcttccaaacattcacgccctttatcggataaagtaaaatgcatctgccgtttatccttatcccccaaattacggacgattaattctttctcttcaatggaacggatgactttagaggtatgcgaagcagacagacctgtgttttccgatatcacactggctgtcagcgtatctccgccaatgcaacaaagtgccattgcctcattcaatgacactccatattgttccatcaagcgggtttcaagttcagagagagccttgaacagctctctcatgacacatattgattttattttctccatgcaaatttaaataaacaagtttacattcgcctgttcggcacggttcatataggttgccactccgccaatagtcacatgatccagcaattcctcacgtttcacacccattacatccattgacatctggcaagcaataaattccactccgttctgaatggcttgagtacgcagagattccagtgagtcgatatttttcttattcatgatatatcgcatcatcctggctcccattccacccatattcattttagacaatctcaactttaaagaactggaaggcagcatcatgccgaacatcttcccccagatatctttcttcaccgcaggcttgtccaatcttttgatagcattcagcccccagaaagtaaagaagatggtcaccttctttcccgtagccgccgcaccgtttgcgagtacaaaagtagctaaaactttgtccaggtcgtcactgaacagaataaaagttttccctttatcctcccggcaaacctccgaggaagaagattgcggagtacttttctcaacaattacctcatactttcctgctcctgactttactgagacaaaacggttcccggtagtctggcaccatgcttcggcatcgcgggggaaaccggcatccgtagcgacaatctccagacgttcgccgtccgccagttcttccatactcttcttcagcttcatgataggaccgggacaagatatgccacaagcatccacttttattgctttcatagaaggaatgacggaagaggcaatagtataagcttcagcagaatctttactgtgttcagaatgatcaacttttgaagaatcagaacttgaagatccggaatttgagaactccttcggcttgggcagaggagccgttgccgctttatacagtttcaaacctcctattaaattccttacttccccaaagccattctgtaacaatatattagaagccagataccctctcaaccccactccacaatacaaatagaccggcttatcctgaggaatctctttcatcctttcgcgcatatcatccaaaggaatattgacagcccccttcaaagcaccgagtgcaaattcatcgggagtacggacatcaaccaacgtaactttactcaaatcggcagcctgcaactcgcgccaataaagaggcttcatctttccgctcagtatatttccggctacatatccggctactgctacaggatctttagccgaagagaaaggaggagcgtatgcctgctccaaagtcatcaagtcatatacagttccgttatgcttaatcacttgcgagaattcgtcaatacgtttgtccactccgttataccccacaatctgcgctccaagtaatttcccgttcacaggagagaaggttattttaatggacatctgtaaagcgtcgggataatatcccgcatgggaaccggaatggatggttgccgacaaataatcaatgcctgcctgtttcaaccgctttgccggaaggcctgaagcagcgacagtcatatcaaaaattttggcaatggaagtaccgacagccccttcgtatgtaaccttatttccaaaaaccatgttatctgccacaatacgcgcctgacggttggccggaccagccagataattcaaccacggtctatcagtcagcggatgacggaactcgatagcgtcgcccaccgcataaatatgctcgtcggaagtctgcaagtaatcgttcaccttaatgctgcgcatctcccctatctccagtccggcctctgtcgccaatgaggtattgggacgtaccccgatggataacaacaccatatcggcaggcagcctttcgcccgatttaaaaataacctccagtccgttgaccgtgcgctcgaaagaagccaccgccttttccaggtagagatgcactcctttctgcaacaaatgctcgtgcaccaaagaagccatagagaaatcaataggagccatgacttgatttgccatctctacaaccgccacttccgcaccggcttcctgcagattctccgccatctccaacccgatgaatccggccccgatgattaccgcccgtttcaccttatgctgctgcaagtaactcttgatagcatcggtatcattcacattacgtagggtaaaaattccttcattgtcaatgcccggcaagggaggacgaacaggcgacgcacccggagaaagcaataatttgtcataactctccgtataagttttcccgtcggaagtacgaatatccactgtcttatcggcagagtggatggctattacctcggaccgggtacgcacatctatgttaaaacgtttcccgaaagcctccggagtctgtacaaacaatttttcccgctccgcaatcacacctcctatataataaggcagaccacaattggcatacgaaatgtattctcccttctcgaacaaaatgatttccgcctgttccgtgtttcttctgatacgtgcggcagcagttgcacctcctgctacgcctcctattactatatacttcataatcgaactattttatttgatttaatattttccaatggaaactttatgcaaacatacatgatatttcttataataaaaagtttcctatggaaaatattatcaagttaactctttttaaggagaaagaacattccgggtattaaatagacaatcactattgttgtttgatattttattccctaccttcgcaataaatttcaaaataaataagaaattgaatcgaacagacgcacatcatgttatctaaaatagacttgacgcagggaggcatcaccggcactctgctacgttttaccttacctatgattataggctcactgctacaacagtgttacaacatagccgacacgctgattgtaggacaatgtataggttccggcgcattggccgccgtcggttccgcctacacgctgatggttttccttatttccatcctgctgggattgtccatgggaagcggaaccgttttttccttgcaatatggagccggacggacggattccctacgccgtagcatctatgtatccgtcctgctgatcggcacagtaacattgattctaaatatagcggttttcgtctggattcatcccatcctcaggatattgcagattcccaaagatatttatggtatgatgtatgattacttgtggattatcttttggggaatcggctttacctttatctataatttctatgcggcattgctgcgtgccataggagatgccgtcactcctctttggtttctggcggtttccgttgtactgaacatcgggctggatttgttctttatcttgcagttggattggggaatcaagggagcagccatcgccacggtagccgcacagggagtatccgctttgggaattatgggatatgcctacgtgaaataccccgaactgagattacaccgcaacgacctgcatttcgaccgtcactgcctgaaagagatcacttcgttctccgcactgacctgtgtacaacaatcggtaatgaatctgggcattctcatggtacaaggattggtcaacagttttggcactgtagtcatggccgcctttgcggcagcaataaaaatagactcgttcgcctatatgccggtacaggaattcggaaatgccttttccacctttattgcccagaacttcggagcgagaaaagaggaacggatccgcaaaggagtgaaaagtgccttgattaccaccgttctcttctctctggtcatttccattctggtctttttattcgccaaaccattgatgctgatttttgtccgcccccacgaaacggaaattctgaacatcggtatcagttatttacgcatcgagggagcgttttattgcggaatcgggattttgttcctgttatacggatattatcgtgccatccgtatgccgggaatgtccgtagtgctcacagtggtatcgttgggaacccgtgtagccctttcctattggcttgccggcattcctgccatcggggtcatcggaatctggtggtctattcctatcggatggtttatagcggacgtcatcggcatcatatattataagtatcgaaaaagctcccaaacaattgaatttaaataaatgtttttgttagtaaaagacatacatacaacaccttttcatctaaaatttatgtatttttgtagccctatagaaaagaacagacatacaaatgatggaagaaacaacctgcaaacctgattattcgaattcgatggcggaacatctgggtatccggtttctaccctccaccgaggatgcggtacatgccgaaatgcctgtagaccatcgtacttcacaaccctttggtatgttgaacggcggcgcgtcactggctctggccgagattgtggcagggcatggctctacgtcgctatgccgggaagacgaatatgcctgcggagtacaagtaagtggaaatcatctgtcggccgtgcccgtcggaggcaaagtattcgccaccggcaaactgattcaccgcggcagatcctcgcatatatggaatatagatatcaccactccacaaggacaactggtttctactgttcgtgtcgttaatttcatactgaaaaagaaatgaatctaccagatatacatacgcaaaaattattggattgcctgacacacagccgcctcggtttcgccctctaccggttaccttggacagacgaatgctacctggtattgcaaacctcgggcgatgtggaacaattagcggacattcaggaactgaatggaaagaaaggatttgtcatggctcctttccggatatcggaggaacatcccttggtacttatccgtccggatgtcaccgcatacgactggagcgaaatcagcgaagcactgtcttcactggaatgtgcggatgccctgctcacctgcaaaagccggcagagtgaactctccccttttgtttccgaagaaacggataaagaacaatatacccgcgcattcgggcgtttcatcactcccttacaagagaagcggttccagaaactggttctgtcacgttcttccgccagacatatcggagatgatttttcaccactcggcgcttttgtccgggcctgcaacaactatccgcgcatgatgatttacctatgccacacccctgcttccggaacctggctgggcagcacaccggaaatcttattaagcggacacggcaaagaatggcacaccgtggccctggccggtaccatgccgatgcagaacgaagtgatgccgacagactgggacaagaagaaccgggaagagcagggctatgtggctgattacatccgccggatcgccaaaagattcggcaacaagatgacggaaaaaggtccttataccgcccgtgccggacaattggtacacctcaagaccgatttttatttcttattgaaaaatacagaccatataggcgatttattgcaagaactccatcccactcccgccgtctgcggcctgcccaaagaggaggctttccggtttattccggacaatgaagggtacgaccgcagttattattccggattcaccggctggctggacacagaggggcataccgatatctacgtcaatctgcgctgcatggaaataaagccgggtgaagccatcctgtatgcaggaggaggaatactggcttcctcggaagtagaatcggaatggatggaaacgggagacaagatgaatacgatgcggagcatccttcatcctgactttataaataaataaatggaaacaattaaagtagaagaataatgtattcagacaaaaagaacatacttcagttggtggcacttctcaaagcgcacggtgtgcggaaaatagtgctttgtcccggcagccgtaatgctgccatcgtacatactctggccaatatagaggacttcacttgttattctgtaaccgatgaacgcagtgccggtttttttgccatcggcctatctttacaagggggaggccctgccgcagtatgctgcacttccggttcggccctgctgaacctgcaccctgccgtagccgaagccttttaccaacaagtacctctgattgtcatttccgccgaccgccccgctgcctggataggacaaatggacggacaaaccctgccccagccccatgtgttcggaacgttagtcaagatgtctgtcaacctgcccgaagtacatactgaggaagacgaatggttttgcaaccgccttatcaacgaagccatactggaaaccacccaccacggcaaagggcctgtacatatcaatgtacccatttccgaacccatttaccgcttcaccgccaaaacacttcccgaagtacgtgtcatcacccgttatcagggactgagcgtgtacgaccgtgactataaggaactgatcgaacggctgaacaagtacaacaagcgcatggttgtggtaggccagatgaatctgatttacctgttcgagaaaaaatatgtgaaaccgctttataaacatttcgcctggctgacggaacatctgggcaaccagaccatccccggcattcctatcaagaatttcgacgccgctgtttattccatgacaccggaacgccaggaagacatggcccccgaaatactgattacctacggcggacacatcgtatccaaacaattgaagaaatacctgcgcaatcatcccccgcgcgaacactggcatgttgccgccgacgggaagatagccgatttatacggttgcctgaccaccgtcatcgagatggatccgtttgagttcttggaaaaaatagctttcctgctggacaacaaacctacccattatccgctgatgtgggaaaactattgcaaaaccattccgatgccggaccttgcttattccgaaatctccgttatcggaaaactcatccgggcattgcccgaaccctgtgccctgcatctggcaaacagctccaccgtgcgctatgcacagttatttacagttcctccccaggtggaaatctgttgcaaccggggagtgaacggcatagaaggctccctgtccaccgccatcggttatgccgccgcttccagcaagctgaatttcatcatcataggcgacttgagcttcttctatgacatgaacgcactgtggaatcaaaattacggtgccaacatccgcatcctgttactgaataacgaaggaggagaaatattccacaccctgcctggaatggacaaatcaagccgttccagggagtttatcacagccgagcattacaccaccgccaaaggctgggcggaagaacgcggctttatttacatgaaagtgaccggagaagaagagctggaagaagcgatgcagccattcacctcacccgagacacggatgcaacccatgctgctggaggtgtttaccgacaaggaaaaagacaccaccctgttaagagaatattatcacggacttaaaaataaaaatgaataatggaaacaagagaatggaaaaccatcaaagaatatcaggatattctgtttgacttttacaacggaatagcgaaaatcaccatcaaccgtccgcgttaccgcaacgcgttcacccccaccaccacttcggaaatcagcgacgccctgtattactgccgcgagtgccaggatatcaatgtagtggttctgaccggagcaggcgacaaagccttctgcagcgggggagatatgcacgtaaaggggcatggcggctatatcggcacagatggagttccccgtctgaatgtgctggacgtacaaaagcaaatccggtcactgcctaaaccggtcatcgccatggtaaacggttacgccatcggcggcggtcatgtgctgcatgtggtatgcgatctgaccattgcctcagagaatgccattttcggacagacaggtcccaaggtaggcagcttcgacgccggattcggctcttcctatctggcacgcatcgtagggcagaagaaagcccgtgaaatatggttcctttgccgtcaatactccgcacaggaagcactggaaatgggattggtcaatacagtcgttcctttcgaccgcctggaagacgaaaccgtggcatgggcagaaaagatgatggagcacagcccgctcgctcttcgtatgatcaaagccggactgaatgccgaactggacggacaagccggcatacaagaacttgccggagatgccaccatgctgtattacatgacagaggaagcacaggaaggagggaaggcatttttggaaaaacgcaagccacggttccaggattatccgaagttcccataatcagtggttcatttttccggtggaggacaacccaatagtcctccttgcttcccattaaccactaatcacgaataagaatgttccaaacccgaattataaaaaaacaattacacttcaagcaaccggcaggtacttccagaggagtatataccacccggaatgtatggtacatcctcctcaccgacaccggcagccgccactatggcgtgggtgaatgtgcccctctccctgccctgagttgtgacgatatcccctcatacgacgaggtgttggccactgcctgcaagaacctggaaaagaacggggaaatagaccgggaagccttgcttccctatccgtccatcctgttcggtatggaaaccgccctgctgcatttccgggcacgcagcctgcaattctggcacaccccgttcagcaaaggcaaagagggcatccccatcaacggactcatctggatgggaaactttgacgagatgtaccggcgcatcggggaaaagatgcagcaaggcttccgctgcatcaaactcaaaataggcgccatcgactttgaaaaggaactggagctgctggcgcacatccgccggcatttcaccccagcccaaatcgaactgcgtgtagatgccaacggtgctttctctcctgccgatgccctcgaaaagttacatcgtctttccgaattccagctccattccatcgaacagcccatccgtgcggggcaatggaatgaaatggcccggctctgtgccgccaccccctttcccattgcactggatgaagagctgataggcatcaaccggcgcgaccggaaaatagaattgctagaaaccatccgtcctcagtacattatcctgaaaccttctctgcacggaggaatcagcggctccgaagaatggatggaactggcggctgaaagaggcatcggctcatgggtcacttccgctctggagtccaatatcggactgaatgccatcgcacaatggtgtgccaccttgcagcccgccctcccccaaggactaggtaccggcttgctgtttaccgacaatatagactatccgcttcacatcgaaggagactgcctttggttccaccccgaagaacaagaacccgacttactaaactggctgaaacaatgacaaaattctgcaccaatagaaacaaacagaccattctgatagaaagcatcccctactccaactgggaaattgaaatggtaagaatgaatatccctgccgacaaccgaagtttccggcaggaacttttctcctttctttccgaatggtttgacccggcagacaccctgccggtacatacttcaggctccaccggcaaacccaaggaactgtatgtagaaaaagaacgcatgatggaaagcgcctgcctcacctgttccttcctcggactgcaaaaagaagattccgccctgctttgtatgcccttgcaatacattgccggaaaaatggtggtaatacgtgccttggtagcgggactggacttgctgcctgtcaccccctccggacatcctttaaaagacctgacaaaagcacccgtctttgccgccatgatccccatgcaagtctataactcactgcaagttcccgaagagaaagcgatattgcaacaaatcagacacctcattatcggaggcggtcctatcgactcccaactgaacgctgcgttaaaagatttcccccatgccgtatggtctacctacggcatgaccgaaaccttgtcacacattgccctacgcagactgaacggtcctgaagcttcagactggtacacccctttcgagagcatacagatccgtctgagtaaagaaaacaccttggtgatatacgctcccgaaatttgcgaaaaagaactggtgaccaatgacatagccgagataaacggacagaaccaattccgcattctaggcagaaaagacaacacgatcaatacaggaggagtaaaagtgcagatagaacaagtagaggccgcattgaaagaacacctgtccgttcctttcctgatcacctccgcccccaacgaaaaattcggagaaatcattgtactgcttgccgaaggacaactgcccgacgacatagaacagacctgcacacatcaattacctccctactggcgtcccaaacgttttgttccggtattcaaacttcccctgacagaaaccgggaaacccgaccgtgccatagccaaattactggcgcaaaaataactccgatccattcataaagggtgaattcaaagaccaatcaaacggtctttttgaattcacccttctttctgtaaaaaagaataattttccgtgttctcctacaacttacggaaagctcaaattgttttcctatcagtatattaaaaaaatcaaatacacgtagtttttttccgttttattttcccttatgtccactactcccggtggaatgtatcattaaattctaattttgtgaagctagatttgatacaaagtatgttatataataacccaaaaccacaggataccaaagaaggactgtccgaccaagatttcagtatttatatggatgcgcacacagtgcctttcagcaaatacccctcttatatgccggcaggagttttgggtatatgtaccgaaggaaatgccgagatccaggttggcctccggaaatatgttatttgcgcaaacgacattcttattttcatgccgggattcctggtttcatttataaaatccagcccgactttcaccatcgactattgtactttttcaaatgtccttttttatgacgtgatcaatggaagtatcaaacgttttccgaccggttttcatacctacacccagacccactgcgtctattcgctatcccaagagaaatcggaacagttctccatctatttccggttattatacaacagagccacttcgccaacttatttatttacaaaagaatctattaccaatctgctgaaattaccttttctggaactttatgcagactattacagcacggtaaaagaacataaagtcaccaccttgcataaagaagaaatcggatacttttttctggatttgctgttaaagcattacaaagaaaacaaagaagtggcgttctatgccgaaaagttgcatgtttcctccaaatacctgactgaagccttgaccctggtaagcggaaaatcccccaaagaatggattatacattataccctgcaagagatttacgcactattggagaatccatccatcagcatacaggaaatcgttcaaagaacccggtttgccaatcttgccaccttaagacgtttcttcaagcggcataccggaacatccctgttgcaataccggaaacaggacttatacaaaaataatcaataggtacctcaataaaaaaatcagcccgttccacacattcttccggaacgggctgatccctctatctaccaaaacttgttgttttccttactatactcaaatccggccgccttcagttttttcaccaacagctccttgtctacattcatatcatcacaaagctcgtccagcgaatgatagcagtcacgaagtttcatattcaccatgctgaaaagcatcatcgggtcatcaggtaattccatatcaatatctcctttttaaaaatcggctgcaaagttacaaaacttttcataatgatacgtattccatcgccaaatatcggtttgacaaaaagttatcccctgctttttatcctatcagtccgtcagcttcaccgtttccatcttccccggaaccaaagtaagacgcgccgttccatccctgtctatctccacttccatataccgggcccggataatgatccttccgtctacagccagtaccccccactggcaggagctgtcctgataggcgcaataaccacccaccggatgcaatatcctccgatagacaggtggaatcaaaatccgctccgctgtcctcagcccccatttcactcctatttgaaaaggtacggcctccacactcctgctgattatacgctgccgtttccgttcatactcgcacttctcctcacgcaagcgtttctccacacgctcgtccgcctgtcttcggagcaatgccaccgcctcatcaaaatcctcactccggtccgacggacggttacaggccacataacgctttccatgccctttctccacatgataataccgtcccttctcatccatcaccacaatactttgatccggcaaccgtccgctcaggtaataagcacgctcctcatccccctccaacagacaaacctgcggttcacaacaaaagcctccttcttccatgcggcggcatcgggaaggcactctgccatcgtacatcttcacataaaaccccatccacacgatggacgaagaaggcaacccgcatgtattggcatacacctgccttgtcctgctgtaataagtacggttcgcctgtaacaattctatgctcccgtatctgaggacacgcgggcggacagaataacaccggccgttccgtaaatccacataagacaccgaattcccggcatgacggacttgcaacaaatcatctttcagaaacctcacctcacggcaatgccccggttcggccaccaaagcccccgtatcatccagtacccggacacacccgttccgaagcctccccacggcaaaacgtcctttgatactcaaaatctctttaaacgaagcgtccggcagcatctcatctcccttttccaatccccaaagacctgtttccttatctacaaatgccctcagcctgcatgacagtgactgctccttctcatccggcaaaacctgctctctgatggaagaaagcaaacgcccgtgctccataaccaccaccaagtccccaccggcttcagccggcctttccaccaccggaaaagcggtaacggaagcatcacagttcatccgtccgggcaaactcctctttcccgccatccgtccccggaacatagcatcccagttccatcgctgtgtaggaagcccgaaaatgcggtacagccccacattgtctatcagcatacacgcctccttgccctccgatctccgcaatccgcgccctacctgctgcaaatatttagccagtgacaaagtaggacgggccagttgtacaaactccacatcgggacagtcgaacccctcgctgaatacatccacattcaccagcacctcgatttttccatgtctgaactcctccaccatccgcttacgctccatagcaggagtcttgctgtccacagccaccgcattcactccccgcctgctgtaatactccgctatccgccgggcatgttcaatgctgatggcatacaccatccccttcttgccggaagcaaactgcctgacactgcggtacaggcgctcgataccgggacgcctgttcagtaccgcatccatctctttcacctgataatccccatcggccccccgtttctccagaccgtcaatgagccgctgctcctcgctgccgggacggatggatacataatcgaacacagacaacacgcctttttcaataaactcggcaatactccacgaagtaaccagtacctcgaacagttccgtgaaccccctacggttcaggcggcaaggtgtggcagtcacacccagtttctttgcggcaggataacgcttccacatctccgtgtaagaagcggccaaggcatgatgagcctcgtctatcacaatcagtcccggagcatcacccgcctcattccagtgccgggacagccattggacagacatcaccctgaccggagtatcctccctccggataccatatttagccagcgtttcctccatttgcgccaccagttccctacgatgggcaataagccataccccgctgccggcagaagacacgaactcactgaccacagatgccagcaaatgtgtcttgcccgtaccggtaggcatctgcaccatcacactccggtgagctttccacgcttccatcagacgtgttttcatctctatctgataatcccgcaacataaataatttgccgatttgctaacgtgccaatggagtaagaggataactgaaaaaattatttactagccagcatattattaatctgcgcccgtatattggctatcgtaccgcccgacacaagccgtttggcaaaaggtagcaacgacttgatgaaagccgctttcaccaccgtgtgtttgtctacattcctacagttctcatcggccagcatctttcctaccaccaccgccagttcgcgtgccgtggtacactctcccaaaagtatcttgtaagccctcatcacctttatatcgggtatataaaccgatacgtaaaattcatcatccgacagttccgccggctcctgtgccggcttctcatccgtcacactttctgtactctccgttttctcagaatcttccggttggtcggcggcctcatcaccccggtcgccataaaagttctgaatggcggaagacgccacaggggcaatcagattgtttccgccataaatatttatcatcatatcaggtttttcattcatatactatttcttttctctattctttaattattatcaacagatcgttaatcaaaatccatattttatcaatatataatcaatagcatgcaccaatagtaaacagatagtaaacggttatgaaccgatttccatacgtcattccctacccgtatatttgtgcagataaatcaaaatcaatttcttttatgaaagaatacatcatgtcatttttcaatgcacccgtcaccaataaaatacccacatgtatatgcagtgtggcagggcttcatacctacatcagcaccaatccgcaactggaagaactgacgcgtaaagtcagagccggactcggagacaagcaagtgttccgaaagaataaacagacccttttaccgtatgtcactccggcaggtatcttctcttactgcaaagagcaatgcatgcaagttccttcgggcctctttgtcatagatattgacgaactggcttccaccgaagaagcggcaatgtggcgcgaccgcctctttgccgatgaagtgctgcaccccgtactttcctttgtcagccccggaaaccagggagtaaaactgtttatcccttaccgcataaaccctttcctgagcgtggaagaatccttcgacaatgccctgcacaccgcatgggagtatctggaatggaaatacgagctgaaagtggacagggccaatgccgacttgtccagagcctgttttctgtcgcacgacggagaagcgaaaatcaataaccataaatattaaaaaatgaacgattctatttctatcttggaacagctggtaacagccatcgaacaagcgggagtcaatgtggcccccacctatcaggaatatatgccgctggcctttgccatagccaacagttgcggagaagaaggacgcacccggttccaccgcatctgctgcatatccgaaaagtaccaccacgatgaagcagacaaactgtacggacatgccctgaccaaaggaacaggcagaaattccctgggaaccgtcttccatctggcagaggtggccggggtgaaaatggacccgaaacttgcaaacttgcagaacttgcagtctctccacacccacacacgtgcgcgcgtatcctataatgcccatccggatgcttccgacgggactccgcccgatgccgttttcacggacccagcctcccccctgtccgacggcgtgtccaagaccatcctccctgcccgacttccctctttccccgactaccgctggcccgccttcctgcaaggaatcatagactgcggtaactctcccgcccaacgggatatcctgctgctgggtgcggcaaccgtgctgggaagcaccctcaacaaactggtaagttttgtgtacggacgaaagcacaaatatccctgtctgcaagtattcgtcaccgcgcctcccgcttccggcaaaggtgcactgacctgggtacgccgtttggcagaacccatacacaacgcgctgctggacacctaccgggaaaaaataaagacctaccgcatggaaaagaccaaatgggacactttggggaaggaaaaggcaaatacccccgaacccgaacagccccagctgaaaatgctcctcatagccggtgacaataccggtacaggcatacaggaaaacctgatggactccggaggcgtaggactgatatgcgaaaccgaggccgacaccgtgagcaccgccattggaggcgaccacggacactggagcgacctcctccggaaatgtttcgaccatgaccggctggcctacaaccggcgcaccaatcacgaataccgcgaatgtaacgtcacgttcctctgcgtacttctcagcggcacgcctgcacaaatcaagccccttatcccatcggccgaaaacggattgttctctcgccagctgttctactatatgcctgccattgaagaatgggaagaccagttcaacgaagcggatacagactatgactcccgtttcctggaatggggggcacaatggaaagaagtgctggacgccatcaccgcttcggtgagcaacatcaacatgaagctcacccacgagcaaaaagagatattcaacttccactttgcccgtgtattcggacgagcctccgccattcacggtaaccagatgaaaagcgccgtaacccgtattgccatcaatatcttccgcatcataagcattatcgccctgctgcgctctctggaatccctgctgccgggaggcgaaaggagcggtgaaccacaggaaaacatcgtgcgtaccctgctgaactgtcccggactgaccccgtcggcccatattccacaagaaaacatagcagacggaatcgtaccgcaattcaacctctccatccgcaccgacgacttttatgccgtgctggccctggtggaacctctgtaccgccatgcatgccacattctctcgctcctgcccgcaggaacccccaccgcaccatcggcgaacatgactcccgaaaccctgttcgactgccttcccctgcgcttcacccgcaacgaagccatcgacaaaggagaacaggtaggagttccggcaggctcggtggactcgctgctgaaacgtatgaccgaacgcggacagctggtcaaagtggggcgtggcgaatacgaattcaacgcgcgcatgcacacacgtacgtgtgtgggtgtgagagagagtgcaagttctgcaagtttgcaagattcctgaatttaaaatgtataaatatgaaagatttcctttatttcccatccatgacaaaaggtagcctggctctgctctattttcccggttcaaatccccggatagccacccggcatctgatgaggtggataaacggctgtccccctttgatggaagagttatccgcaacgggttaccatacctcgcaaaaagtcttcacgagccgccaagtgacactgatcaaccggcatctgggcagccccggatagccctgcaagctctttggaacaggatgaaagccataaagtgccacaaggtgtcataaagcgtcagcacgcatttcacagtacctatctttgcaatgtcaacaatgagggagccgatacgttactaaccttcggcctagcatgttactaacatgtaaccccatacgttactaaccttcagccttacacgttacctacgtgcaatccgcaagaaaagtaaagtattctccctcttcactgacgaaattcattttttatttttcatctcttaaaaccctatttatcatgatcaactacagcacctgcatgcgtggtaaccccaccgacaaagacgcggccaagaaggcgtatgccaacgcccagtactcacaagtaatgacactggacaagttctgttaccacattgccagccacggatgtgtatactcgcgcgccgatatccaagccatccttattcttgccgtggactgcctgcgcgagcagttgttgaacggacagcagatacagatgggcgatctgggcgtattttcgaacagtatccgaagcctcggcgcccattcgatggcagagttcactgtggagaacatcaccgaggtgaacgtactgtgggctccgggcgtccgtttcaacaacctgcgccaagatgccgaattccaactggttcccacgcgcaaggcagccgccgaagtagtgaaggcattgaaggccggaaagactacggtagacctgacgggcaattcttctgccgtcggcattgccgctgacgacgctgacgcctcccgcattccagccgcctccggcgaaccggcagacgaaaatagctgaccggcttgttccgctccacagagatagcatgatgtgattatggaacacgggcgacacggactcttctttcactcccccgtgtccgtccgccagttccgtaacctccttttgttccattcgcattttaaactgacaaaaaacagatatttccatgaatgaatccaaccacgaatccaagaaaatcacctggacacaaatcctccgggcagttatccaggcagccatcgcggcactcaccgctttgggcattaccagttgcgcatccctcatctaaagaacaaacacaacattttccaattctcaatttattatgatacaagaaacattcccaatgataatcggtgaggaagaaatgaaaaacgaacgccaactcctcaccgtagaggacggaccgctgatgcaaggacgcgaatcagtgcgatacctcatcctccactgtagcgccacacgttgtgacaaagactatactgccgagcaattacttcgtgaccataagacccgtggtttccggactgtaggttaccacttctatatccgtcgcgacggcaccatcacccagcaccgcaaactgctggaagtgggggcacactgccgtccctggaaccgttgcagcatcggcatctgctacgagggcggtctggatgcggacggacatccggcagacacccggaccgcagagcagacagaacagcttaccttgttgctgatgcgtctggcaaagctttttcccggtgcccggataaggggacatagggatatgagcggaagcatcccgaaggcttgtccgtgttttgacgcggaaggggtgttcggatatttggaaaggtaatttctttttccaaggtttccttttgccagtgttcgtttctgctctcaagtagagagtgatactactggcagagggaattttttactaagatcatccggccggtaccgacacaccgaaacagactatcatatagataaaaatccttcctgttacgggttattgtataatccgcgtttatttttaaagctgaataaatcctgatcggataatcttctttattattaaagctccgggaacaagcgctctcgttcccggagctccccctgcacttttcaatcatcttcatatgccatcttattttttagagacatttactgaatatccctatttatatctctgtccacctcttttatttacgtgaaacaattgtccctgtagcttgattagtaggcataaccaacatttctgcaatctgcatatattccggtacggaagctgcaaaataaaccgtttccgcaatatcatctcccgtcaatggacgaatgcctttatatacattatccgccttttccttatctccccggaaacgaacaactgaaaaatttgtttccaccagccccggtttgatattagtcactctcaatggagtatcaactaaatctatacgcagtccatccgataaagctttcacagcagcctttgtagcacaatacacactacctcccggataagcagcatctccggcaatagaaccaatattaataatatgtcctcgtttacgttccaccattcccggtacgatcaggcgtgtcattgccagcaaagccttaatattagtatctatgacaatatcccactcatccagactgccttcctgttctttatccgtaccgataaccaacccagcattattcaccaatatatcaatggattgccattccttgggcaatgattccaaagcagacgttgccgctttacggtcgcgcacgtcaaaaggaagcaaatatattttcgcaccatattgcttttctaattcttctttcaatgcactcagtttatttacgttacgggcatttaaaatcaaacttgctccctgtgaagcaaacttgcgagcgcatccggcaccgataccgctggaagctcctgtgataaaaacaatcttatccattttattatttcgatttattaaagaacttactgaaaaatagtatttgatagtctatggcattattccaatacctgcctgtatgcccacccggacggatgataaagtcatgatttattttcttcttcaacagtttttcgtgtacagccttattcacttccagaaaaaaatcatcacaaccgcaatctattataacagccaaatcaccattctttatcttatccaactgattaattaccgtatgttcgtcccatctctgcttgttgctcgcttcttcacctaattgcttcttcatctcccaattattgggaaacggacggatatctaaacctccactcatactacctcctcctccaaagacatctttatgacggatggataaccataaacttccatgaccacccatacttaacccggtgacagcacgtccccctctctccgctttcgtagtaaaattcttatcaatatagttcaccaattcttttgacacgaatgtttcataacggtactccttgttcaaagggctgtcccaataccaactgttcttcccgtccggacaaacaaaaatgattccttccttatcagctatccgaggtaattccggttttatcccgagccatgttcccgcattgcccccatatccgtgaagcagataaagtacgggacatttttcacctgccatggctttatccggacagatggtaattacctgaacctctttattcattgcatcgctatgtaccgacaaagtatccaccttagctgcctgcattcctacagacaaacaccagcttcctatcaaaaaagcccaatatcgttttttcatgtatataaaaaattacccgatgtaaaggtacaatataatttgcaatttagttgcatcttctttccgctatctttgttgtcataaataaaaagaaacaatgaaaaaaataaaattagaatcagttttcaatgaattcactttaatgggaatagctgtatcaggagcattctatctaggagaatactgggaaggtattgccgttattctgttctatctcataggtgaatggttccaacacaaagctgtacacaaagcacgcagcgacatcaaagcattattggatgtacgtcccgaaacagccactgtaatatataacaacacatataaaataacagtaccggaaaaagtacagccaggagaaaccattgaagtaaaagttggagaaaaagtacctctagacggatttttgctggaagattccgcttcatttaatacggccgccctaaccggagaaagtgttccccggactctatataaacaagaagaagttttagcaggaatgatcgcttcagataaggtggtacgaatcaaagtaaacaaaccgtatgatcaaagtacgttagcacgtatcctcactttagtacaagatgcagcagaaagaaaagcccctgccgaattatttatccgccgttttgcacgaatttatacaccgatagtgacaggactggcgatactagttgtcatactcccctatttatactctctgataaaacctgaattcatttttgtttttgatgattggttctatcgggctttagtattcctagtcatatcatgtccttgcgcattagtggtcagcattccattaggatactttggaggtattggtgccgcatctcacaaagggattcttttcaaagggggtaattatctagatgccataacccaaataaacaccgtagtattcgataaaaccggaacactcacccaaggtgtattcagtgtccaggcaatatcggcagccgaaggtgtttcgcaaaaagaactgcttcaacttatcgcctctatagagagtttcagcaatcatcctatcgcaaaagccattgtcaaatatgcagaagaacaaagtatatcccttaactcgtcactgaaaataaccgaatttgccggatatggaataaaagccgtaacaaacggtaaagaagtatatgtaggaaatgcacggttattatcaaaatacggcatctcttttccctatgaaatcagcgacatgacagaaacaatcgtgttatgtgcaatggaaaacaaatatttgggatatctttcattggcggatacaccaaaaccagatgctgtacaagccatccgcgaactgaaagacttaaatattaataatattcaaatattatcgggagacaaacagacaattgtttctaatttagccgaaaagataggtgtcacacaggctttcggcgatttactacccgaaggtaaggtagcacatttagaacaattaaaagcaaattctgaaaatcgtgtagcttttgtaggagacggtatcaatgatactcccgtactggcactcagcgatgttgggattgccatgggtggcctaggatgtgacgctgctatagaaactgcggatgtagtgatacaaacagaccaacccagtaaagtggcggaagctataaaaatagggaaacagacccatcgcatcgtatggcaaaatatatcaatggcattcggagtgaaattgttagtattgctattgggagccggcggaatggccactatgtgggaagccatatttgcagatgtaggcgtagctttactcgccatttttaatgcaatgagaatacagaaatggaaagaataaaatgatttgacctatgaatgaaacaatctatttaaaaaaactggaacagcgggaaatcaaaccgacagccatacgtctgcttattctaaaaaccatgatgcagcacaaagaagcattttcactgttggatttggaaaacgaattggatacggtagacaaatcaaccatctaccgcaccataaccctttttttagcccatcatctgattcatggcattgatgacggtacaggatcgttaaaatatgcagtttgcagcaatgattgcaattgtgaggtagacgacctccacactcacttctactgtgagaactgtcaccgcacgttttgtatgaaaagtatccacgtgcccatcgtgacactacctcccggattcaccgtacaaagtatcaattatgtcctgaaaggtctatgttcggaatgctctcatcagcatgtgtaactattgccagaaaaggaaatcacccccaaagcccagttgatataatccaatgcaggcatccgaatttactgatcggatgccattcatctaattgtctgttattcaaagctgtaatattttcttatatagtatccgcccttttaatgaacatcaatcaagaaatacagtatttttattggggagcaagaaacttcttagtcagccattttcttacaggctcatcatacagtttcagacacaggcaagccaaaatgacactcaaaacaaaaacacccacagctacataccaagtttctcccaatgtataaagtttattctcaatcaaccatgcgtagaacaaatacatcaacggataatgtactacataaaccggataggatatatctcccaagaacttgcatatctttgtagactgcttatccgtagtagtacccgacgcccccagccacacaagaaaaggaaaaaccacaattacacaaaaagcttcataaataccattcatgcaaataggctccaatccttccagataaggaaccgagaacagcgcaatcagtataatagtacatatccaaaacgccccattcaccttcataggcttgaagttacgcgacatcaacatacccaatgaaaatgggaaaagcatacgcaaagttccacctaagaaattcactccgtcgagtgtccatcccactcccatattcccataaccagacacattgaaaacagcgaatgacgctaatgccatacccagcatcacaaccagcacagccaatgctttattagataaccgacgaatgaacaacgcataaagaatattacctatatactcaaaaaacagggaccagcaaggtccgttcaacggaaacatctcaccattaccacgaacttcatatcccacacccggcatggcaggaataaagaatattgtacaaagtaaagacaacataatcatggaaatagcgacatgcgttccatcccattgcacacaaccctgaatacagaacgtaatagctcccaaaacagcacccataattaccatcggatgaagacggatcaaacggcgtttgaaaaagtctttcatagtgaaattcttcccccaacggtcatcatacgcataaccgataacaaaccccgaaagaataaaaaagaaatccacagcaagatatccgtggttgagagtttcgatattgccggcactagcaaaagcaaaaccttcaaatacatgataccatattactataagagcagcaactcctctcaatccatcaagaagatcataatgaggctttgtatcagtaaatgctgcagaagagattttttccataataaattaatagatttaataattgattctttttaattgttactaataatgctgcaaagttacacaacttaaaggcttttaaatttgtcctatgacaaaaaatcagcaatacataaattatttcttagctcggagacgactaagtgtgggaagtgttatacccaaataagatgcaatataccttaacttcacccgttggcatatctgaggaaactgttgtttaaactcctcatatctttcctttgctggcaaagtcagccgttctttgtgagaacgatgcaaacgcctgtactcattttgatgaataatcctcccccaattagccaattcaatattagtctgaaacagtctggttaaatcagctaatgatattttgtaaacaactacatcttcaagcgtttccacaaattcctcgctcggcttattatagtacaactcgtccatactgaaaacaatacctccttcccatgaaaaggaggttgttatttcttctccatttacaagccagaaagaacgtgtcattcctttttctatgaaataagctgatttacaaaatgtattctcctttattaactgatatttcttagggaaacgacataaaatcatacattttttcagttcttgtatcgtatcttcagaaaccggacacaaagagagcatattatctataatgtttgtcataaaaccgtagtccattaaaatacatataaacacacccgatataaacacgggatataccttttttttcttttcagccaaaagtacaaatatatattggaaaacgacatcatttttccaaataatcggagtttccaagaccactccatacaagaatgtccatatacctcttttatttattactttttgttcaaattacaaagataaagcattaaaatgccaaccagacttttaaaacatcccatcgcttaatgcaccactctaaaagaatttcaatagcctccaaatcacttttcatataatctatcagaaatttcataccaagaaaaccccaaagaaataccaaagaattgaacattttttatgaaaaacagcccttgacagattagcggatgcaggctatttttgcattttaacaattataacccttaaaacaaaaaacatttactttgcagtatgaagtatttattatcggaagaataaattcttaattaataatctgctactgctttaaccaacaagtccaatcacatgaaaaaaattataacattacttttaatattgttgtttgccacaaaaagcactttctcccaatcgccaaacaatatagagaagttcgtcgtagtcagtgtaaatgataaagatagtattttaaacaaaataaaaatgtctgctccccaattctacaacatcggaaaaggtaaacgtatagaggtcaaagtatgcaatgaagacagcatacaaataagaagagtacgctgtcttttatattattccaactccggcaagaaagaatgtataggaaaaatatggatttctcctcttattggctacgaaacctgctatttttgcatgaacgtggatatccccctaacaaaagatgaatggcataaactaactttccgaataaagagaggaaaaaattataaggattacaaattcttgaaacagcaagtacaagaataaaacatttgataataagagagagattgacaagaataagaacaagtaagaattgtttttattttaagtttcagccttaaaataaatctagatttatttcataccattctgattatttgtatatttgtctcttgataataaaattatgcaatttattaatttacaaaaacgatgagctatatccaaaacaatctacaagctggtgaagaaattaaatacaaagcagatattcactggtatatatttgcatatccggtaatactactattattaagcgccttcttttcttccgcacaaaccggattattctattatgtcagcatacttctattgttgtcaggattattccaattgataaaaagaattcttcttaaaatgggagctgaatatgttgtcacaaacaagaaagtcattctaaaatccggtattttaaaccgggatgcccttgaattggttttaaacaaatgcgaaggaatacggattaatcaaagcctcatgggacgtatgctcggttttggttctattgtagttactacgggcggggtcaccaacaaatttgactttatcaccaatcctataaagttcagaaacgaaatcaatgcacaaattcaataagaataagtgaaaagcatttaaagaaatacaaagagaacgggtataaacacgcttttgcacatacatccatacaaggctatacctacgtacgtacgagcttatgcgtatgtatatgtaaaatgcctcagtccagaataaaattccatatcaaagacaagggcgttttaaaaaaagatcaagagctttttaaaaaagataaccgcctttttttaaaagaacaagagctttttttaaaatgtcttgttcttttttaccgctgccgcgaatccgtaagctatcatttcgtggaagtttcctctttcatgcgcatttcttacgaggaaaaggcttgaaaacgccctactttataccaggcaggaactgtctataaaaaagaatatatggctgacagcaagcatattatgtgaaaatcaacttcaaaacgtagtgagggcatgagagtataagtgagagcattttttttaccattatcatataagtcattcataataaacccattatacatacagtgagggcatgagggtataaataccccgaactttctaatgaaaaaatatgcttatttttgctatgcaccaaaaacaaaaatccgccgtaaagtattaatttacaggggattttctttgttttgtaattctttccagcggagagggagggttctgaacctcttctctttatttccgtatatatcagcttattagctttcattattttgcttcctgtaacgaatttgtaacgacctaaacttttgtcctaatgaccacttttgtccgctattcgtctaccatagctttcgggttcaaaagtatggaaaatatgaacatcttccaaatgtttgattattaattatctattttttatattccaatgcaaggtgcgagcctatatatatgaataggcttgcaccttgcaccggactttatcttgcacccgactccatcccactcatttccaatcgtcatgtaaaaaaagttatgccaagttggtaacaagttggcaaatgccccgatttaattcgatgaactttgtgccaaactttaaaagataagtgtatggacgtaataacaatggaggcgactgcctataaagaactaatccgcaaaatagaaaagattgcagactatgtattcaaaaaagagagtaaaccaaacgaggaggaagagatatggttggataatcaagaagttgccaacttgctacgtataagtaccaagacactgcaacgattaagaaaagaaaatctaatcagctattccatgttacgaggaagatgcagatacaaattatcagaaatagaaagaggactaaatgagaaaataatcgtttgtgatccacatacgctggatgagttccgtagaaacttcttattcaatgggaactatgaataaagatgatattctgcgattgacagatagaggaatggctatattcaagcactacctccctaccccatttcgtgtaggacgtaatttccttaatccgctttatgaggataagcacgcttcctgtaacatctattatgagcgaagaagtgatacttataaaatgaaggactttggtaatgacgactattcaggcgactgtttcgcattcgtgggaaaattgaatggactagattgtaaagattctaaagacttcattcagataatgaaaataatcgatcgtgacctgcatttgggattatcatcgggaaattatattgaaacgaagactattactcccatcagtcctgctgtcacggcagcaacatcgccatccaaagtgaaaaaggcaaaaccttatacgttggcgcaaaagagctttacggctgcggaacttgccttctggggaaaaagcggcatcacgcaagaggtactgagattattccgggtggtttcactgaagaagttcagcagcgagaataacgaagggaaaccgttcagcattgcggcgacggataaagaaccggtgttcggatatactgcaaagcaatatgtgaaggtgtaccgcccgcactcggagatgcgctttttatatgccggggattttggggagaattattgcttcgggttggagcagttgcctgctaagggggatttactctttattacgggtagtgagaaggacgtgatgagcctgacggttcacgggttccatgctatctgcttcaattcggaaacggtgactattcccgtgggaattattcataggctctctttccggttcaaacatattgtactgctctatgatgtggacaaagcggggctggacagttcggcaaaacaagaactggcgttgaagaactacggggtgaaacgattgttgctgccattggcgggaacgaaggtggaaaaggatatttcggactttttccgtttgggaaatagccgggaggatttgattaaactatttctggattatctggatacaatatacagcgaaactatgtctgctctaaaatcttgtgaggtggattttaataatccgccacctgtggcacaaatggttgtgtcggtgaatgatgtgccattaggcacgcaagggaatatcctctgtattaccggtggtgagggaaccggtaaaagtaattatgtgacggcgttaatagccggtgccatcggacaatccgaaaagaacaaggataaggcgatggacacgttgggggtgtcggtcagtgaaaacagcaagcggaaggcgattctgttctatgatacggaacagtcggaggtgcagacgtacaagaacattacaaaccttttaaagcgttgcggacgggaatcaatgccggaatacctgaaagcgtattgcctgacgggaatgagccggaaagaacgcttgcaggcgattatccaaagcatggataagtttcattatcagttccgggggattcacatggtggtgatcgacgggattgcggacttgataaagggtgcgaatgatgaaacggaaagtattgccgtggtggaggaattgtatcggctggcggggatttacaatacttgtatcgttactatcctgcattttattccttcggggctgaaattgcgggggcatttgggcagtgagttgcaacgaaaggcggcggctatcctctcgatagagaaagatactgatccgtcggtgtcggtggtgaaggcgctgaaagtgcgcgacggcagtccgttggatgtgcctatcatgcagtttgcatgggataaagatgtcaggatgcacgtgtatctgggggaaaagccgaaagaggaaaaggagaagcggaaagaggatgaactcgtggcagtggcacgggatattttcggacggcaggactttattacttatgtggatttggcagaacaaattcaagcgatactggacgtaaaggaacgtacagcgaaaagttatatcaagttcatgcgggagaaggaaatcatactgaaagacccgtcaaaccaaagttattatatcatcggaaatttaaaacaggcgagcttatgataccattggataaagaaacattcgaggcgtatatggaacggttgctcgaacaagtggaaaaggtcgtaggcgcactggacaagaagaataagaagccgcaaaattacctgaatggtgaacggctgtacgataatcaggatgtttgtctgttgctgaacatcagcaaacgaacactacaacggtacagagacaacgggctgaagtattacacgatcttgcataaaacgtactatcgtgaaaaggatttgcacgagtttattcgtcggtattttgacggggagaatgtagaaaaaggcaaaacgaaggaatgtaacggagatgaacgtatagagggtggcatgttgtccgatgataaggatgaacctatggaagaagataagccggtggatgaaggtaaactcacagaagatgcttagagagttataatttccatatagaaaattctgccgataccctgacgttatgtgcatatcccgtactatagtgatgaaaggataagattcacatgtaaacttgtgtatatagtagttacaatgttttggagaaaaggaatttagagtctaaatttgcaaacaataatcagattatgaagttttatattagaaaatcactaactttgtgaatattatatccatagacagaaaaaaagaaaataatatgatacttaaaaaaataacaattgaaaatttccgttgctttaaaaactatgaggttgatttaacaccaggaattactgtttttattggtaaaaatggcgcaggaaaaacttctctactaaatgccattcgttatggattaagtgtctttttttccaatgatagcacaatgggagatgatttacttatatcaggtaatcccgatttaaaagtcatttcaacattagctacagatttttatcgagcccaaaatgcggatttaccagcagttgatttaacaatcaacatggaagctgaatttaatgatatacctttgaattgggaatactataagcgttctacatcaggtgcttcgttattcgtttccaagtatcaacaagcatatcgtacacttatggcagaatatcataatagcgaccaacttccactgtttgttttctattctgattcatttccacatatagatacaagaaccagcgattttgcaaaaaaagctattaaggaacaaggatatattatcaggaattttgcttattacaaatggaattcagaagtatcatgtacatctatctggcaaaatagattcattaattccatgctaaaacaaatttcccttaatgatagtgacccgttaaattctaaggaagtagaatatataaaaaataaattgcgcactttttctgaacctatcaattctgcgttagaagaaaaggatgattttgaaataaaagatttctttccggttgtagatgataagacgctatcattatatctgcgattaaaaaatgaacgggacgttatctttgataatttacctgctggatataaaagactatactccattgcttttgatttggcttatagattatatattttacggaaaacaaacgaggaagacccaaaaggtattgccataattgatgaaatagacctccatttacatccttctttggaacaagaagtgttagctcgtctgaaaaaaacatttccaagtattcaatttattgtatctacacattctccaatggtactctccaatcttaaagtcaaagatacgggaaatatgatttatagaatgcaggcagacgaagatacaccaaatgcattgcctaatttatatggcgtggattattctgctgctgtttatgattttatgggaactccttatgcagacaatgaggttaaagaagaaatagaagccatcttaaggctttcaagaagaggtaagccggaattagtagaaaaaaggaaagaagaacttaaatctatggtttcggaggaacaatacataaatattatctctaaaataaactctcaactggcagaggacaaatactaataaagaatatgcaatttatcaataaattcaaatataagaggaaaggacaccgaattatcaaggctttcattaaagataagtggaacaatgatattcaaagatatgtaaatttaaactacaacgaacttaaaagaattaaagcgtttaagtatttactgctcaaagaacaacaaggattttgttgttattgcatgagaaaaattccttttaatgaggtgactttagaacatgtaatgccacatcatttagaggacaaaaagcgtaaggaagaggtaaaatattacagtaagtttggacgattaaaaagggggaaaatatattattgcccagataaagagattcccatatctcccaaactacatactcctccctatccccattgcattgcacatgaaaatttagttgcttcttgtcaaggaaaggtctttgaaggtggagaaaaatatatactacataaatgctgcaataactttaggggaaatgataaaattgttccactatttttcattccgagagcagcagagattgtacgatatgaaattgatggtacattaacttattttgaaaaatacgagtcaaccatcagctctctaaatttaatgcattcaaccttgattttcatgaggaagatatgggcaaagattgttataaataatattagtttaaatcaggtaaataaggctttgactgataatgatattagaattaacatcattgatgatattgatattgacatttctgaaagaaagaatctaaggattgacttatattggaaattattgatcgagtaccattggttttataattactttcagagaatgatagcataattcaattataaacaatcggataaaataaccgccatcactttggacatgaagtatggcggttgttttttagaatctaaatcatttttggggttctgcaagaacagacacctcatagttacgactatattattttatctataatattttttttattaactttgtgcattaaccttttgaatatagaatatgacaggacaagaagaatatcctcgtttcatttctaacagaccatgcggaaatgataaatacgaagggaaatcacaagagccgaagggctggagattttacaaataaaaatttgacaggcaatagacggtcgtttatcttcgcacatggaacactgcttaatagttggctccctatagattggcaggagtaaatgaggaagaaattataaagagaaaaatgaagaaaaaactttgtgataaccattaaaaaagatagctcgctgggagctatccattttattatcatgacttcttaaagacgaaatgctattaatcttttacattaatccctaagatatatgctataaatttcttatttttgccacgagaggataaatgtcctctgtatttagtgagtttatttaccgttccgagaaatcgccaatttcaaaacacaaaggtaagtaaactggctcggtcatatactaacgtgacctgtcagttacttttgtgttgggcgtttggcgatgcctttggaactgtaattggcagtgtcacgttctttaattttatatgatatggaacaatttaatgaaacccctttgcagggtattttaggaacagataatggaaaactgttctatctcttacaaatcgaaaaagtcagtgatctcgtaaaactacggggagatttaagtactgctatcgacctaatttcaaaatgcggaagttcagaggaaggtataaatgctatcaatgctttgaataggctactttccggattgatgaaatatgataatgaccattatgaagcaatggatattgctctttccagtaccatgaaagtactgaaaaataaataatctaattctcgctaagatccgaatgggataaacaatcataaaaacaaccttttggcataatcggaaaagaaatgttttcggctggctggtgaagatttatattcgatggccagatgaatacttttctacggttatggataggcaaaatgtaaattccggtacaatgtacaggaaattgctttttgacggataaacggtttttataccgatgaaagactttgaaaactttaaatatcagtagttttatatttgattgttttttgaataacgattctaagaattgtttggtcacctgttctcttcctggctggtattatggtatcaagacgttatagaaataatgaaacgaaatcatcagattgtctttcccaaaaagactcccactaccgaattggctcccaaccgcatacatttacgtttcatctggataaaactctggccggtggttgcgatatcgtcgaccagaattatatcttttccttgaatatattcgggatggaaaatgagattggcaagtttatcattaccagtactgccttttagttgttcccggtcttctttgatccaaatagcacggaaaccgtccgctacttttagacgacgagataaaaggctacaaaaacgggcaaagcgagcgatatttcgctcacgtgtagcggcggggataggtataaggataggatcattcatttccttaaagaatggcatgcgacctatacagagtgagaaaattttagcaagtaaaggagcggcattttcgcttccttctttaaaacggaatactaaattgctgacctttttttgatatagggtcagttctttggttctggttggataataatcgtggatataaaaacataatgtaccgtcgtaccgcaccttgcctttaaaataggtatcataaggaaagaactgacggacgaaatcaccctcgaatgtaaaatggagtatgtcacgccaaaggttcagggtggtttcatcctgcaggcgatagagttcgccttctataggttccttatctgccaacccaacaccgattgtcaggtggtcgttgaatttgtctttggaaacgatgtaccagtcgaaggaacggcttatcttttctatcgggcagtcgtgagaacagaggaagtagaacattccatcctctttctgtatgaccaggaactcgccggacatttcaacaagctggaaatagttgtatataggtgcgttgtctaaatcttcaaacggaacggaaacgacaagattctcaatcataatcaatagtttgttcaaaggtagagttttttgaggatattaaaaaagcctgatacgtttatttatgcatcaggctctgatttaccatatcaggggagatttagttgggtatctgcgggtactggatggaagcatggcgggtgtcagcattgaacacgacaattacctcggttgctttcttgtccatgcggttgtattcgcaaagggcgttcatcacccattccctgaaggctttggcgtagcgggaatctatgcgatagcttaggaaaatgatggcttcgagattgtaaaaggtgacgtagatgtcctgacctttttcgttcttcatcttacgttccatcgttacgtcatcttcatgaagcacgccggacttgaagatggaacggaagttgttgcccaccgtctggagatgtacgtcgaaaaggcgggcaatttcatgcttgaacatccatacggttccgtttactattttgacttcgacaatgggtttgccgatttcttcctctgtgattttaatatatcctctttccataatgattttgtttggggggacaaatatactgatttaattattctgccttgttataaacgctctctacattacctaattttccggccaaatcttccatatcattacttatcttgctatttgttatacgtgcatagatttgcgttgtttggatatttgtatggcccaacattttactaacagtttcaataggtaccccctttgcaagcgttatagtagttgcgaatgtatggcgcgctgtgtggaatatacaaggcgaagcaagcaataatgaacaggtaaagattaaacgtaagtcgtttgaaatgagctgtatttctgtattctgcaaaatgtggaaaatgcaaacgacaacagaatattgaggttgttcaattaccaaaccgttagccgggcggttaccgaaacaaaaataggtaacggtaagcaatgaaaagaaatcctcaccgttttgtttgcactcatacacagtgttttgcatatcaaggaacgcttatatggcaagtatttttgcactaaaaagtataagcgtatgaaagtagaaaaattcaaggtgttgctctacctcaaaaagagcggaccggacaagtcgggaaaagctcccatcatggggcgcatcacggtaaacaggacaatggcacagttcggatgcaaactgtcctgcactcccgaattatggaatccacgtgaaagccgtctgaacggcaaaagcaaggaagcggttgagatcaatgccaagattgaaaagttactgttagcggtaaacaatgcctttgacaaccttgtgaatcgcaaggttgatttcgatgccaccgatgtgaaagacctttttcagggcagcatggaaacgcaaatgacgctcatgcgaatgacggatgttgtctgcgatgacctcaaagcccgtatcggcatagacagggcaaaagggacttatcccggttatcactatatgcgcctgacaatcggggagttcatcaagaccaagtacaaggtgaaagatttggcatttggacaactgacagagcagttcatccacgactatcaggcatttgccaccggtaataagggttatgcgattgataccgtccgccatcatcttgccatcctgaagaagatatgccgtctggcgtataaggagggatatgccgacagaatccacttccagcattttaccttaccaaagaagacggaaacgacaccacgggcattgagtcgtgaatcgtttgagaaaatccatgatgtggaaatacccgcttaccgcaaatcccatatactggcaagggatatgtttctcttcgggtgctacaccggggtctgttatgcggatgttgtctcgattacccacgagaacctatatacggatgaggacggtgctttgtggttgaagtatcgaagaaagaaaaacgaacttcgtgccagtgtgaaactgttaccggaagcgattgcgctgattgaaaaatatcatagtgaggatagggacaccctgttccctttgctgcattggtcaaatctcagacgacacatgaaagcgttggcggcactggcaggcatcaaggatgatttgtgctatcatcaggcgaggcacagcttcgcctcgctgattacgcttgaagcaggtgtgccgatagaaaccatcagcaggatgctggggcattccgacatttccacaacacaggtctatgcccgtgtcagcccgaagaaacttttcgaggacatggacaagttcatagaagccaccaaagattttcaattaattctttaatacagaaaacgatatgcgaagtacattttcacttttaccctacattaaccgcagcaaagtaaaggctgacggtacgaccgccatactctgccgcataaccattgacggcaaacagactgccatcagtacggggatttattgccgaccggaagaatggaacagcaagaaaaacgagattaaatccgtaagggaaaataaccgcttacgagaatatttacgactgacagaggaagcctacaatgaaatactgaaatcgcaaggtgtggtcagtgccgagattttgaagaaccacatatccttgaacaacatccatccgaccactcttctacagatgggagaatgggaacgtgagcggttgaagaagcattccgaggaaatagactcgacttcttcctatcgaagttcaatgtattatcagaagtacctgacggattttcttacgtccatcggtaaaaaggacattccccttgaagaagtgacggaggatttcggcaagtcctacaaagcccacttgaagaaatgcaagaacttcggggtttcccagaccaaccattgcctgcgttggctgaaccgcctgttgtatctggcagtcgataaggagattcttcgtgtaaatccctgtggggacttggagtatgagacaaagccggaagcaaggcacaggtacatcagccgtgaggagttcaagaagatactttccacaccgatgtatgacaagcgtatggaactggcaagacgggctttcatattttccaccctgacgggactggcgtatgtggacatcaaacttcttcatccccaccatatcggaacaaacgctgatggcagacggtacatccgcatcaaccgcaaaaagacaaaggtagaggcattcatacccttacatcccatagcggagcgaatattgtcgctgtataacacgaccgatgacgagaagcccgtgtttcctcttcccaaccgtgatgccctatggtttgaggttcatgaattgggaataaccataggaaaagaggaaaacttgacctatcaccaaagtcggcacagcttcggcacttttttgatttcggcggacataccgattgagagtatcgccaagatgatgggacactccaatatcaggacgacacagggatatgcacggataaccgatgataaaatttccaaagatatggacaaactgatggaacgaagaaaggaaatatcggctggcgaaaagaagaaatagcaaataatcatcataaaataaaggaattatgagcagaggcataataacaatcagtgaaacgggtgcagtcaccatgccgaccgcacccgtatggatgatgcaatttgagattgccgacctgttcggtgtgttctcgtgcaatgtccgcaagacgatacgggcaatctataagaacaatgaactgaatgaagccgatacgatgcgatatatcaggcaaccggatggtatcagttatgacgtttataaccttgaaatggttatagccattgcattcaggatatgcagtaaagaaagtgctgtgttcagacggtttataataaatgaaatcagcaccaccaaaagagaaacacctgttacgttgtttgtttcctgtggcaggagtaataaccgatggtatagttgaggttcatcccgtcagccacttgtttccgttgccacacgtttgaaaggcatccggcaacgggaacaagcgactgccggaaaaatcagaagatagaaaggaaccacttacagacgaagcaggatattgacgcttaatccataagccgttcctttttgttggaagtccattgctccgcaatcatagggcagacggcaaactgcgctccttcaaaaaaaaaaatcaagttaccctctgtcggtaggcagagcggtagccgtcattcagcatccgttcgatgtcggattcacggtagaggattttaccgcccaactggatataggcgatacgcccttcattgcggtagtcctgaagtgtccggcggctcaccttcagccgtgccgacacctccttgtctgtgaagaaacgctcaccgcccaatgtcgggcggtaattggcggtcaggtgctctacattatcaagcagtcggtcaagactgcccataaagtggattatccacttgttgtccttgttaatcaactcattcatattactctggatttagtgggtgttgtcattatatttaattcatatagcctttcctttgaacttcgcttcctttcttctatcctccacaacggagacaatgagctccacgtcttcgggacggtaatacgtcttgtggtttatctgtgaataagccagcgtgccgttatcccgaagcgtctgtaacgtgcgagggctgatgttgagcatacggcacacgtcctgattatccatccattcgctcattttcttttccccgtgccgatggcagatggcatccatacggctgacgaaacggtcgaacttggcgaccattgcctcaaaggtctttctttcgattgatacaatttccatattgcctttcttttaattattacagtttcttttgccacaaagaaatatattatctgctgtcatgcaatggattttcaaaaagtggcagcgtgttgcgccgatacggtagtcattgtccggggtactgcttgccggttatctgtgagcaagccggtggaatacgatttccgttcagcctttaattcccatgttttataaagaagccacagccaaaataagggcttaatttaaaatagcccccaatcgtacctttgtcctttcagctattcatatccggcaaatcggtgaagtccgcaccgatttatcagtctccataaagcaaaaccgtacaaaaatgcctaagaaaatccaagtgcttgactgactgcattaaagcaccttacttcgctcccgataatcggtcgaggtatagaccaagaccacattcaataacttaattaatttgtttttacaatgaaaaaagaaccaaacattacagagcatcaagctcgtgaaatcgtggaaaaaatggggcgcagggaaccctacacctccaagtcgatagacgacttctacaggagtatcggtctggaaccggaagagccggaacagcccggcaagaccgtcacggaagaagcagaaatacctatggcagatgaaccgtcagaagtggcgaccggggaagcggcaataccgcagaagcgtatcagtggcaaacagcgcaggctgtctttagaagagtaccgcaccacctatctcaaagttcccaaaattatcaatcgcaagcccgtgttcgtcagtgagacggtgcgtgacgagctggacagggttgtccgctacctcggagggaagggcatgagcgcatccggacttatagagaaccttgtccgcctgcacctcgatgcctaccggaatgacatcgagcaatggcgcaaactctgacgggattacggtggaacaggttgagccgttggatgcacttcatcggttcgaccgatacacaaagtgagttattacactcggaaatcaatccgacaggcggaggatttttgtgtcctcaaagacacagcaaggtatgttttcagttactcggatgttccggagtaactgaaaacccttgcaccgccgtgggcagaattatcctccgaagtcggataatttcgaggttctttaatcaaagattaaacagtgaacaaaccataaaattgaaagaataagaagcatgaaaaagaacaacaagtacggaagaaatcccaagttgaacccgaagacgcactgcgtgatggtgcgcttcgatgatgtggaatggaacaggttcctcacgatgtacgaagaatcacaggtgtatgcgaaagctgtctttctgaaggcgcatttcttcggacagaagttcaaagttctgaaagtggacaagacgatgctgaactactacaccacgctgtcggacttccacgcccagttccgtgccattggtacgaactataatcaggtagtcaaagagctgcgatgccatttttcggagaagaaggcaatggctctgctctacaagttggaaagttgtaccattgaacttgtgaagttgagccgggagattatagaactttcaaggaatatggagaagtgttaccaatcaaaatccgactgatatggcatcggttaaggtcaaattacgcccatccaccgtgaacggcagggagggtacactctactatcagattatccataaccgtgtggtcagacaaataaacaccgagtataagctttttgtttcagaatgggactgccattccgaaacggttgtcttgcatcatctatcgacagaacaagagagaaacaactatctgctttcaatcggttcacgcatcaagtgggacaaggagagactgaacaaaatcatacacacgttatcccaatccgacacatttgtaacggatgatatagtcgtgcgctttcgaggaggtagacaagaacaatcatttaacgactatatctgccaacagatagcaagattgaagcgtttggggaagatacgcacttcggaaacctatatggcggcactccgaagttttagcggttttatgaatgacaaggcggtcttgtttgaccagcttaacgccgacctgattgcggaatatgaggcttatctgaaaggaagaggcaattcgcccaataccgtatcgttttatatgcgcatactgaaagcggtctataaccgtgccgtggaagatgaactgactgagcaacggtatccgttcaagtatgtttatacgggagtggaaaaaactttgaagcgagccttatcactcaatgccatcaggcgtatcaaagggcttgacttgtcattgaagcccaatcttgactatgcccgtgatatgttcctgttctgtttctatacaaggggaatgtcattcatcgatatggcttatctgaggaagaaagacttgcaaaacggtatcctttcctaccgcagacgtaaaacgggacagcagttgttcatcaaatgggaaaaatgtatgcaagatattcttgacaaatatccagtaaacgaaacggaatacctcttgcccattattacagaacgtaatgaagattaccggaaacaatacgccaacgcacttcatcgggtaaaccatctgttgaagaaaatcgggaaactgctggatttgccaatacccttgacaatgtatgtcggtcggcattcatgggcaagtattgccaagagccgtaatgtacctatctctgtcatcagcgaaggtatggggcatgattcagaaagcactacacagatttatcttgcatcgttggatactactgtagtggataaagccaataagaagatattggatttgctgtgaagcggtagatgtttatcgaatctgtccaacgcttgccaagagacggatgactattcttatcttattgatacagagatatgtttggcttttatatgaactgttctcacaaaacacccaacttttcttgtaaaacaaaagaatggtaacacacaagatttccagcatcttatatcctaataatcattattttgcgtaactttgcattataatatccgtctcttggcaaaagacggtttcagaactaatataattgatagcgatatttagcatagatggcacatagtttcattacaaatcaagaacgtctgcttgcagatattataacaggtatcttacccaaatcggatgccgtggatattcttgtgggttatttctatttttcaggatatgcccaacttgccgacaagcttgtggacaagcatctccgaattttggtcgggcttgacattgacacccggatttcaaaccgagttcgtgaggttgaagaattggtagagtggcagcgcattcgtagcaaagttcgggaagaatacttcaataacttagtgagactcatcaatgaaaccgacaataccgatacagacgaaaccatcagaatgtttcgccaattccagcacaagatttatgacggtacattggagatacgcaagacagaagccccgtgccatgcaaaaatgtacctctttgcctataacgacagtaacaacgagaatggagaacaacccggtgatgtgattacggggtcaagcaacctttcctatcaaggattgcaaggcagaacggaaatcaatgttcggtttacagacaaaggtaaatatacggaaggaaaacaagtctttgatgagctttgggctaatgccatttccattgtggacgaaaataccattgaccgttggaaagaaaaagtcgaaagccaaatttggattgaccatttgtttcagccctacaaactttatctgcgagtgctcaacgagtattttgacattccgtccaaaactaatgtacggacacctttcgacattacagatggtaagtttttcaatctgaaataccagactgatgccattcaacttgcgttaaagtctatcgaaacccacaacggaacgattgtagcagacgtagtaggtttgggaaagagtatcattgcttccaccattgctcacaacctccgtctgcgtactattgttgtgtcgcccccacacttgaaatcgggttgggacgcttataaggacgagttcggctttatggggactgtgtttagcggtggcaaaatatcggaagccttggctcattacaatgatttgaagaagccctatgaacagttcctgattatcgtggacgaggcgcatcgctaccgtaatgaatataccgaagattatgccatgctgcacaatctttgccaaggcaacaaggtggtactattgacggctaccccgttcaacaacgaccctgccgatatctattctatgctgaagctctttcagataccgaccaagtccacacttaaaacggtggaaaatctcagcatagagttccgcgaccttatcagccaatacaaggaacttcgcgaacatcaacgacaaggcaaaatctccaaacaggatgtgaagaacgaaacagccaagatagcccgtactattcgttcaattatcggacctttggttatccgccgttcacgcattgacctacagcagattgatatatataaagacgatctaaaaaagcaaaagattgaggtggttattccacaggatcctattgagctatcttatgacctcaaggaattgaaagacttgtatctgcgcacgcttaatctcatttatgggacaaaattaaacgatgaagattctgacaatggcgtttatcgttttcaggcggctcgttacaagccggtgctgtatgtccccgaagacaaacgtgaggcattagccaaggatatagaacgccaaacgggacttgacgatgtaaatatgcttatcggtcgtcaagcgaacgtggctaaatttatgcgccgtttgttggtacgtcgcttcgaaagttcggttgcatctttcaaatcttcgcttgcctttatgataaattcttctcgtaatgtgcttgattggattgagcgtactgggaagatacccgtttggaaaaaaggtggtatgccagatgtggatgatttctatgaaagcaccgatgacggcatggaggagatagaagatgcatttgaaaaatattcaggcaaaggtttctttgttattgatatgaagtttgtcaatgacgaatttgtcaatgacgtgaaagccgacatcgcactgttgaaatctatctatttggaatggttcggagaggaagatgtaatcaagttcgacccaaaacttgaatcgttcatccgtcttgttcgtgagaaactcaccaaagagcctaatcgcaaattggttgtgtttagcgagtttgctgacacagctaactatcttggcgcagctctgaaagaagcagggctgcctgcgcttaaatatacttcggcagatgctactccctctatgcgccaaaccattcgcaataactttgacgcaagtgtgaagcaagaaacgcaagccgatgattacaaggtattggttgccaccgatgccatttccgagggttacaacttgcaccgtgccggagctattttcaactatgatataccgtacaatcccacaagggtaatccagcgtatcgggcgtatcaaccgtattaataaaaaggtgttcgacaacctttatatctacaactacttccccacggaggtaggcgaaacagaaattcgtgccaaggaaatatccaccttgaaaatggcaatgattcatgccattatgggggaagatacaaaggcattgacttccgatgaagaatgtaccgctttcttccgcgaccgttaccgtgcggaaatcgagcattccgaaacggaatcttgggacaccccgtatcgccgtttcttagagtcggttaagggaacagacgaatacaaagaggctttgcagataccgcaccgagcccggacgggtcgcatcgtggagaaaccgcagggtggtgttattcttttcggaaagaaaggtgaagacttcgtattcaaaatatccgatggagaccacgagccgataatgctctctgccgaagaagccttacagctctttgaagccgcacccgaagaaaaaccgtttgccaccaccgagggcttcgaccgattgtatcaacgagtgaaattttcgctattccgcagcgatacaaagaaccgcaacgacaagaatatcttaaaggcgattcaaaaaatcaatgccataaaagttaagttgcccgaagattactattccgaccttttggcggctctcgatgcggaagcgttgtctggctacgaagtgcgtttcatcaatcaggtgaaaccgtctgagattcaaaaattattcaaagagataccagccgactatcttatgcgcttgctcgaagtgcaagccaaagtcagcgagggtgacgaaacattaatcatatctgaagaactgcaacgatgatagattttagtaaagcatatagccgtgcggactttgtcaattacctccgccgtgattttcttcccgatgatttcgagcaggaagaaaagaatattccgttttggtcacagatgaactatgcatcagtggctacttgtcttggcaagtcaaaaatgcttgatcttgtggtttatgaaatcaagcacagctcgcgtcacgatgcccgtgtggggttgtcgaaagatgcgtttcgtatgcttgctggggagaaacaatcccgtgctttggtaatatttgttcctgaaaatgatgtaagtaattaccgcttttcgctgattgaaatccaactttctatcggagaaaatgatagtaacgttactcgaacttattccaaccctcgtcgctattcttattaccttggcaaggggatcgcttgctatacgcctaataaatatttgaatgaattgggtagggttaaggatgtgaaagatctttttgagcgtttttcggtagaggtgcttaccaaggcattctatcaagagctgtccgactggtatgcttgggctattaaagttatctcttttcccaacgacattaccaagcatactgatgataaactacacaatcatgaaggagcaatccgccttatcactcgtctaatttttgtgtggttcttgaaagagcgtaaactcattccatggcagttcttcgaccaaaagtatattgcgatccaccttatcaagggctttaacccgcataagattgacaaccttttcggtaaatcggaagcaagtgtttattatcgcgctatcctgcaaaaccttttctttgcaatgcttaactgtcctattaccaaggatggaagcacagaattgacagaacgccgattcaaggacaaccgttcgcagtttgatgataataaattgatgcgctatcgtgatgagtttaacgaccctgacgaattcttgcgccttgcaaacgaaaccgtgcctttcctcaatggcggacttttcgactgcttggacgaaaaacgcacgggaatgtattacgatggtttcagtgaacgtaaggagtcaatggcacaactgattgtgccagactatcttttctttggtgaggaagcgggcaagaacattgacctctcggatttctacggagatgccaacaagaagaaggtatcggctcgtggtatcattgatattctcaaacgctataacttcactgtggaagaaaatatgccctttgataaggatgtgtcgcttgacccggaattgctcggtaaagtattcgagaatttgttggcgtcttacaaccccgaaacgcagcaaaccgccagaaaacagacgggttctttctatactccgcgcgagattgtgcagtatatggtcgatgaaagtcttgtcgctcacctcaaacgcacggttggtgataacctggaggacgaatatcgtaagttgcttgcctatgccgacagcgaaaccgtgctcaccgaacagcagaagttggcgattatgcagtcgctctacagttgtaagattctcgatccagcttgcggttcgggcgcattccccgtgggtgtgctccagcaaatggtacatatcctcaaacagattgatccagataatagtcgttggaaaaatatgctcctgcaatttgccattgatgaaacttccgaagcgtacctcacttcgaccgctgaagaaagacgagaagcagtcgctgatattgaaagatctttcgatgaaaatgtaaactacccggactatgcccgtaaactgcatcttatcgaaaactgtatctatggtgtagatattcagcctattgcaattcaaatttcaaagctccgtttttttatttcgctcgtcattgaccaaaagcgaaatgataatccagcagataatttcggcattcgaccgctccctaacttggaagctaagtttgttgctgcaaactcgcttcttggtttgaaacgaacagaagtaactctttttgactcagaagaaataaagcagaaggagcgtcaactcaaaatcgcaaagcacaagatttttagtgctcgtcggcctgctactaaggaaaaatggcgcaaagaagtggttcgcttgcgtcaggaaatagctgacctcttgcttgacaaagactgtataggtaatgagcaagcaacccaacttgcacaatgggatatgtttgaccaaaactcttttgcccctttctttgaccctgaatggatgtttggtgtcaaagagggcttcgatattatcatagccaatccaccctacatttctacaaaaggtgtttctattgccgataaaaaattatttgaagcggagtttggattctccgatgatacatacaacttattttttttcaaaggtttttctttactttgtaaaggtgggtgtattacatacattacacccaagacattttggactactcaaactaagcgcaacttaagagatttactgcttaccaatacgcttaattacgtatttgacactgccaatccatttgaagcagtgatggttgacacttgtattacctctgcggttaagagtaaacctgcagcagataatgttgtgcgctttatggacggtcgtaaagatttatctttacccgaacatctcaccgtgccccaatcagtatatctcaacactcaaaatagcgtaatattcaaaccgtccgcgttgaatatgcgtatctatgagctttacggtgaaaaggtaaaagctctatatgataaatggtgggacaagattaaaacttcacgtgacattgaaaagaataaacgcgaacttgaagaatatcgggcgagtctgaaacccggtgatgttgcacttcttgggtgcttgaccgagggtggacaaggtttggctaccgccaataacggcaaatatatcgctgtcagaagcaccaccaaatgggcaaataatattcgcatatctcgtcctaagaaacttgctgattttttggctcgaaaaccagaagccattaccgttgaaatgcgccgttattcatcgtatgcagtttttctgcaaacactttcagaagcagagattgcagaactcttcgattccctcaaagagcaatatggtcgtgacatttttggtcagggctatctttacaagattgtagaggactgcgaaatagcagatgtggactctttgacggatgacgaaaaagagaacggtatagaaacgaccaaaccatactatgtaccttatgataaaggagataaagacggaaatcgatggtatcttgaaactccattcgctattgcatggtctaaagagaatgtccgttttttgaagactaattccggcaagaaaggggaaggtatgcccgttgttcgtaaccctcaattctattttagggagggattgtgttggagtgacattaacacgacttttctcaaatgtagaattaagcaaaagagtattcatgatgtaaaaagcatgagtgtatttggcgtttgcaacaaagtacccgaaaattacattttgtgcgtaatcaattcgaccctgattagttattacgttgatacatttataaataacactcaaacatttcaaattaacgatgcacgacaattaccgattatcgttccaacggttgaacaattgtcattttgtgacaccttggcaaaggatgcaatagcgcaaaagctaaaaggagagataccccaaagcgtacaagaaaaattagatgattttataaaatgtcaggtctttggtttggtatagggagggcttttgttggaataaccttttgaatcccaatgcacgattattgaaagtaaaattaaagggcgaatctgtaaatgacgtaggttctatgtcgctatacactaccaatattctttcaaacaagtatattgttgcattgcttaattctaatatcttatttgattattaccgagagttcataaactgctccgttaacgtacaaataaatgatattaagcaacttccaataattattccaacgaaaggtcttgcttcttcgatagaacttttggcagataaggcgattaaaaagaaacaagaatctgcaaatgcaaatttggaatctattgaagtggagacagaggatttaataaaaatcctctactccatagaatgagcgaaccaatctatcaaggtcgtattgtttttcttccattaggatttcatcaatcactgctgttcttttgaggctgatgcaatcagcaactattttttgcaatgattcaaatgcttccttttgagggattattataggtagctgccgtgcgtcatttatctgaaaatgagaagtattgttgataaaattgtcaacatataggctaataaattctgaatttattagggctacatagtaccaatcaggaaggtttgtcattgtgaatagactcatactcaacacatcaaagacgccatttgctttaattcttgctttaaggtaggtagagtttacatctatccaacaaaagccctccctaaagtagaacgtataaccttggtatcgagctttcggatctgtcttcaaaaaacggacggttaatagataccgcgttcccaccttccattttttgattttgttggtatccttaatccggtgtatgccaagtaacgatatagtgtaccccttgcaatcttcaatttcttggcaatctgaggcacacttatttcttttgccatttgactttctatgtatttgtgttttgctacgcatttagcatttaacttcttattgcgtcgtcctttccctctgccaatttgatgtccttctttttttaaccgggcaagtgcttcttttgtacgttgtgaaatcagattgcgctcaatctctgctgacagcccgaaagcaaaggcgagcaccttactttgtatatcatcaccgagacgatagttgtcttttatagtccatactcgacattctttagtcatacagatattcagtatctccataatcatgaatagattacgtcctaaacgagatagttctgcacaaatgatcaaatcatctttctgtacttgctttaatagctttcctaattcacgtttgtcgtaggatttagtaccactgatggtctcttcaatccaaccatcaatcttcaatttctcattttcgcagaacttgttgatttcaaaacgttggttctcgacagtctgtttgtcgctgctaactcttatgtaaccgtatatcatattcgtatcctttttttgaatatgataatatttttaattgataatcagatgataatctgcgaaattatatgtttaacattttatttaactcaattaacaacccaataagaaaacgctttttatcatttcttttagaacttcataggtataacatattagatttcggataaaaaattgtacctttgcacatagagaagtgttcttttgatttaatgcaaaacaaggtaagatacagaacttcgctcgtttctaaatcgttacctattaataaaccggcctttgcaagcttctcattttcaataaagaagaaatatgactatgccttgcaagatgaaatgtcaaatttttatctataccacaaaggtcacctatttctttcaaatatgagttcatcttttgattactaaggactggcaatagaactttattaggcagattatttttgtattttgctaatattttcagaggaatatccaacaagggaacattcacattggtatccgtcttttggcgatgggtcataatccatagttttccatcgaaacctgtacggagattatcttctgtcaaatttttgacatctatgtaagctaagcctgtaaagcacgaaaaaataaatatatcacggacattattcaatctatctgtcgcaaatttctttttgataattttctccacttccttttctgttagataacctctatctacccgtttcaaacgaatggtataattagcaaacgggtctgcaaagatccaaccattatttttagcaataataattatgcggcgaaaaaactgcatgaatttagcagtcgtattctcattacaaccactttcactacgcaggtaggtttcaaagtcagtaataaacatatggtttatctcctttaaagaaatatcagagatattatatttgtatttcatgaaatcaatcaaacgtctataagtacggtcatacttagctattgttgcaggcgtcttgcttattcctactaacttttgaatatcttcattgtgttgtttgaataattccaataaagtacgctgacgagtagtaattcctaaaaatgcattacggattttttctgctgtaacaaatgcttctgtgttttctatctcatgataatgattaaccagcgatgcacgaatattatctaacaatgcattaaattgggcagcctgaatacttctgcctttcaacttgccagccttgacatcccactgtcctggatcgacatccaatttagaactgaactgactgatttcgccatttaatgtaatgcgaatcattatacctgtcttgccgttcttgttcacgtagttctttctcacataaaagagaatcttaaaagtactgctgctcataattcttaatttttaaacctttggggaatggattaattcctccgccacaaaggtaaagttaataatgttgttataagctatgcagacatggacaaactctgtacaaatcaaggacttatagtggaaatcgttacagaaacagaagcccaattttatgtaacgaatctgtaactgaactctgtccgtttttgacttttcaatggtttcaaactgtccggaaggtatataaaaaaagtccgtaaaacgctggttttacggactttgtctgcttttgaccttttattgtctaaaggtttcagcggagagacaggctctcgaacctacatattcaagaaatatcataaaattgcaaatcattaataatcaagcactatttggagtacatagtaaatctaaatctttctgaatatcttttgctattccaaatattgggtgtatatttgggtgtagaatttcaaacacacccaattatgaatatcaaacgaaacatcatttttgcattggaaagccggaagaagaacggtgtgccaatcgtggagaacgtgcctatccgtatgcgtgtcatatacgcaagtcagcgcattgagtttacaacgggttaccgcattgatgtagccaagtgggatgctgacaagcagcgagtgaagaacgggtgtaccaacaaactaaagcaaagtgcatctgaaatcaatgccgatctgctgaaatactataccgaaattcaaaacgtgttcaaggaatttgaggtacaggaagccatgcccactacccaacagctaaaggacgcattcaacctgcggatgaaagatacaagtgaagaccaggaagacgtaaagataagtttttgggaggtattcgatgaatttgtaaaagaatgcggcaaccagaataactggactgaatccacatacgaaaagtttgcagccgttaaaaatcacctcaaggagttcaaggaagatttaacctttgaatatttcaatgaattcggactgaacgaatatgtcaatttcctgcgcgacaaaaaggatatgaggaacagtaccatcggtaaacaaatgggattcctcaaatggttcctgcggtggagcttcaagaaagactatcaccagaatatagcatacgatacgttcaaaccgaaattgaaaaccacccccaagaaggtaatcttcctgacatgggaagaactgaacagacttaaagactatcagatacccaaagacaaacagtatctggaacgtgtccgggatgttttcctgttctgttgctttaccagtctgcgttattcagatgttcgcaacctaaagagaagtgatgtcaagtccgaccatatagaagtcaccaccgttaaaacggcagatagtctgagtattgaactgaacaagtacagtaaagccatacttgaaaaatacaaggacatccattttgaaaaccacatggtattgcctgttatcagcaatcagaaaatgaatgattatctgaaagaactgggagaactggcagaaattaacgaacctatacgtgaaacctactataaagggaatgagcgcatagatgaagttaccccgaaatacgcattgctcagtactcatgcaggaagaagaacattcatctgtaatgcgctggctctaggtattccggcacaggttgtaatgaaatggacaggacacagtgattataaagccatgaagccctacattgacatagccgatgatattaaggctaatgcaatgaacaagtttaaccaactataaaagtatcagtctgtttcacagattatccattattagagttatctttgttaagtaatagttagtaatatggaaaataacaacgaacataatataaagaaaggtcattttgatgcctttgtccatgctgtcggttcggaaatagaacaggcacaagtccggctcattaccgcagccaatgcccagatgttgttccattactggaaaatgggcaattatatactgtaccaccaaaacctgcatggctggggtggtaaaattatcaagaagttggcacaggcaatcagattcaattatcctgaaaagaagggatattcggagcgtaatcttacttatatgtgccagtttgcccgtttatatccgttaaatgtacttcgtagttttattgaaacagattcaatactgtcagtccctaatattcaaaacattactaatgaagtccttaaactcaacagcgggcaatttacgcaggagcttactgcgcaaatacaatcagctgataatcaatctttagaaattacgcaggaggttcctgcgcaatttcagaatgtagaaaaaacagtagcaaccatctataaaataaaaatagaggatatagaagatttattcttggcgtcaccgattgcaagaataaattgggcaagccatatggtcatactcaataatccgctaccattaggtgtaaggtattggtatatgaaacaatctgtagaaatgggttggagcagtaatgtgctgaaaatgcagattgaaagtaatctgtatgacagacaaatcaagagtaacaaggtaaacaacttcactgccacacttccggcacctcaaagcgatcttgccaattatctgttaaaagacccgtatatctttgacttggcaggagcaaaggaaaaggctgacgaaagggatatagaagaacagttggtaaagcatgtaacccattacttgctggaaatgggtaacggctttgcttttgttgccagacaaaaacatttccagattggggacagtgactttttcgccgacctgattctatataatatcaagctccacgcctatgtcgtcgtggaattgaaagcaacgccattcaaaccggaatatgcagggcagttaaatttctatatcaatgttgtagatgataaactgaggggagaaaatgataacaagaccatcggtcttttgctgtgcaggggtaaggatgaggtcgtggcacaatatgccttggctggatatgaccagccgataggtatcagcgactatcaattgagcaaggcagtacccgaaaatctgaaatctgccctaccgagtatagaagaagtggaagaagaactgaccttattccttgacaaggacaagaacccataatataaagtatatggcaggaaagatacagacgatgattccccaatatggagaacttaacagaatatacagagactatatagataattacgctttttcttttgacaggcagaaattcatatcggatttctatcaggagtataatgacatgaaatcctttgaagccgctatccttgaactggtgcttgacaagcaaaaagagcaatacaccttgatactcaacagtctgaaaactgaaatagaaaagagcatacaggcttatgagatacgcccgttaagtgacagagccatagaacgtgcttgctatcagcacatggaaaggtattctcaggaaattgaagcccagctggatgttacaagaagtctgagcaagccgctgaatgaagccaacaacaggtatgattccattggttacagggagcatacagccgaagaggaaaaacaggcagagaaagaatatgaacgctgcaaggctgaatatgacagggaaaaagccaaactgaacaaactctatgaccagcaaaaggctacaagaacagaggcattccaatatatgaagaactgttgtgcggacatataccgtcaaagctgcctttttctggatatattgaagaaatacattcctgacggaaagcaagagaataaatcaagcgagccaatcagtcagcaggaaacgacagaagaacaacaggaatatttcagcatgaaattactttcgctcattcatgaggtgtgcaaaggagaacagttcgaagaaatttccgcaccagatttctatgccaatatgaatcttcacccctgcaactgtaagctgaaaataaaaccgagagagaaaatacgtgtatgctatctgatattcctgatgagcgagaaactctccaaacaggacagggacaaatggaaagacagaatactgaaactgctggatattgacgacagctactacaaatccaagtacaaggagcctgtttcagatttccccagtgacagcaaccaaaatttcgccaaggaaatggaacatatattcagataatccgtgatatatcctgatactttacgaaagttccacttttaccactcaaaataatttttgagtggtatttttgttttctgatattcaataagatacaatgatattcagtttgtaccgtccccatccttaccactcataaccctacctaattttgcatcgttcgagaacagaaataacagccagtgcgcagggctgattgtttaacgactaaatagattggacgatgacaaatatccaagaattattatcaaaacccgtctggcaaatgacaggcgaagaattcatattcctgagtaagcacgcttcaggtcaggccgaagcattgccgcaacccgttacagacacggaaaagaagtatgtgtacggaatactcggtatagccaaactgttcgggtgcagtctgcccactgccaaccgcataaagaaaagcggtaagatagacaaggcgattacccagatagggcgcaagattatagttgatgcagaactggctcttgaacttgccggaaagaaaacaggaggacggaaataatgggaggtatgcttatggactatatgagagaaataaaggaaatatctgcagaacaggcgataatcctttggcaagcctcacgtctgagcctatcgaaaatctatgagaaagcacctgagattttaaaagtgcaaggttcggtcattggcacactgggcaatttcagtgcatccataggcaaagccaaaagtaaaaagactttcaatgtgtcggctattgtagccgcctcattgaaaaacggtacggtactacggtatgtggcagaacttccggagaacaaaaggaaagtcctttatgtggacacggaacaaagccattatcactgcctgaaagtcatgaaacgtattttacggctggccggtcttcctgatgacagggacaatgaacatctggagtttctcgctttgaggaaatacacgcccgaacagcgcatcaggattgtcgaacaggctatctataatacaccggacatagggcttgtaatcatagacggcatccgtgatatggtatatgacatcaacagtccgggagaatcgacacgtatcatatccaagttgatgcagtggacggatgacaggcaaatacacatccatacgatactccaccagaacaaaggcgatgaaaacgcaagagggcatatcggtacggagctgaacaacaaggcggaaaccgttcttctcgtggaaaaggacaagagcaacggggatataagcaatgtttcggccatgcacatacgtgcaatggatttcgagcctttcgctttccgtatcaacgacaatgcattgcctgaactcatagaggggtacagacccgaagcgaagaaacccggaagaccggaagaggaaaagttcgacccttacaggcatattaccgaacaacagcaccgcatagcactagaagcggctttcggactgaaagaggaatacggctacaaggatctggaaaccgccttaatcaagtcttatatgtcagtaggtgtaaaactgaaccatcaaaaggcggtatcacttatcaccatgctccggaacaaacggatgatagtacaggagaacggcaggaaatacacgttcaagccagactttcactattagaccgtctaacctgtaatcacttcactttattcggcaggtctatatattaaggataaagcgaagcgattgcagagaatgtaaaaccgcttcactttattaccgtatcctatatatacgaaaataaagtgaagtgattatacagaccgtacttcataaaaaggtacgggcgaaaagagaaataaatattccaaccattattcaaacactcatcttattatggatatacaaacagcaaaacaaatcaggatagcggattttctgtacagtttgggacattctcccgtcaagcagcaaggtatcaacctgtggtataaatccccgttacgggaagagacagagccctcgttcaaaataaataccgaacgcaaccaatggtatgattttgcaattggtaaaggtggaaatatcattgcactggcacaggaactctactattccgactatgtaccttatcttctacagaaaatcgaggaacagactccgcacatccgtcccgtatctttctcttttggcaagcagtcattttccgaaccgagttttcaggagttggacattgtacagctgacttctcctgccctgcttgcctatctacaggaaagagggataaacacggcactggcgaaaagagaatgtaaggaagcccgtttcacccacaacggcaaacgttatttcgccattgcttttccgaacatatcgggtggatatgaaatccgcaaccgatatttcaagggatgtatcgcaccaaaagaaatatcccatatcagacagtcaggaaagccaaggagtgcatgttacgtttttgagggatttatggattacctttcctttctgaccttaagactggaaagctgtccgcaatcacccgacttcgacagacaggattacatagttcttaattccgtagccaatgttcccaaggcactctatccgttgggaagctatgagcgcatccactgtttctttgacaatgaccgtgcaggaatggaagcaatacagcaaatcagaaaggagtatgatgctacccggtatatacgtgacgcctcgcaaatctacagtggatgtaaagatctgaacgaatatttacagaaacgaatagccgataggaaagagcaagcgcaatctgtcaaaaagaggaatgatacactatccaagaaaccgaaaggcttccggttatagcccactataactacacgcttcgctttcgtagttgtgggctctcccgaggggattagggctttgccctaatgacccactcagggcgtttcacccctgagaaccccgagcaaagagtgaccctctctttgcaatctccgcttatgggttacccctaagaacccctctgcgaaagcgagcaaagtaaatcaattgtaaacaaaggaaagaagctatggcaacaaaatcaagcatacatatcaagccttgcaacatcgcatcgagcgaggcacacaaccgaaggactgccgagtatatgcgtaatatcggggagtccagaatctatgtcgttcccgaactttccaccgataacgaacagtggataaatcccgacttcggcactcccgaactgcgaactcattatgacaatatcaagcaaatggtcaaggaaaagaccggacgtgccatgcaggaaaaggaaagggaacgcaagggaaagaatggaaagattatcaaggtggcgggatgctcacccatccgtgaaggagtattgcttatcagaccggacaccacactggctgatgtacgcaaattcggtgaagagtgccaaagacgctggggcatcactccgctacagattttcctgcataaagacgaagggcattggctgaacggtcagccggaagcagaagacaaggagagcttccaagtcggtaacagatggttcaaaccaaattatcatgctcatgtcgtattcgactggatgaaccatgaaactggaaagagccgaaagctcaatgacgaggatatggcaaccatgcagacccttgcttccgatattctcctgatggaacgtggacaggcaaaagctgtcacaggtaaagagcatctggaacgaaatgatttcatcattgagaagcagaaagccgaactgcaacgtatagaggaaaccaagcgacacaaggaacaacaagtaagccttgccgaacaggaactcaaacaggtaaaagcagagatacgcacggacaaactaaagaaaacagccaccaatgctgctaccgccatagcaagcggtgtaggttctcttttcggaagcggtaagctgaaagaactggaacatcacatcgagcagctacatcaggaaattaccaaacgggacaaagctactgatgaattaaaaattcagatacaacaaatacaggaacagcatagcagacaaattcgtaatcttcaaagaatacataatcaagaacttgaagccaaagacaaggaaatatcacgattgagcaccttgcttgaaaaagcccacaaatggtttcccatgttcaaagagatgttgagaatggaaaaattatgcgctgttatcgggtttaccaaagacatgatagaaaacctcttgacaaagaaagaatccatacaatgtagtggcaaaatttattccgaagaacacaggtggaaatttgacatcaagaatgatatttttagggttgagaaacatccgatggatagtggtaagcttatgctgaccataaaccgacaacccatagtacaatggtttaaggaacaatgggaaaagttacagcagaatctacgtaactcggtgcagagagagcaaaaatccagaggatttagaatatagaatagcctattattaataaaatcaagtatctatgcatccaaacagattgtttttattacagaatcaaaatcctaagaatttataaaaaatgaagcctaaagaagttttggaaaaatggatagattgctttaacaaagcagatgcttatcatatagcagagctgtatgctactaatgcagtaaatcatcaagtcgcaaacgaaccaataattggtaaagaatcaatctacaaaatgtttgtgaatgaatttgccactgctaaaatggtttgtatggtggaaaatatttttgaagatggcgaatgggctatcatggaatggaaagactctcttggacttcgtggatgcggattttttcatgtaaaagataacaaaatcgtctttcaaagagggtattgggataaactttcattcttgaagcaacacaatcttccaattgaataagtactatcagaatacggactgggaaattgaaatacccagtccgagttatataatgaattttacttgttaaactatttaaagtcagttggataacaaaccatacctttcacattctcagtagctccaggtattaattcagccaccatgcaatattcatgagagacttcgaaaggaaattcaattcctaaatcgatagccttgcgatagccaaatcgaggataatactctttatgccccaatacgactgctgtgccgtaacccaaaagtgctgccctctgatgggcttactgaatcaacatcccccccccaattcccttacgctggaattccggcaagactgccaatggagctacactcagggatgtgacagactgggtgtcactatctatctttacttctgtaagtaagatataccagacaatttgtttttctgtcattttcttgttcttatctaattgttaggctcattgttgttatacattgtttaattatagataaatcgtgaatatccttctctcttaaatcgtagcccgaatggaatacttgttgcccttttgcagaaatgcaagggatgcttctgccttcaaagactgctgttccaaaatagtccggttgaaattcataccagcctccatccaagtcggcttgtttggaagtgccgtccgcattcaagacaaaaggatggatatcaatatagcctaattctttgctatacagttccacacgggtgggcaaccaatttgtttcaatttgatatcctctctcctgcaaaagatcaaggagttggtctgtataattggcatcaaaatcaatgtcaatatctctatgcaagcgggtttgctgtccgtacaagacatccactccccagcctccatccaaccaaaactgcatgtccaggctttccaacaagtccaaaacttgaaataactctgtaatcgtagtgtgttctttctttgtcatataataattctttaataaataatactatgcgtaattatccaactgcttgattgaagaaataaaatttgcacccactccaatcagaaagataacccatccgctgatcataaagacggatgtgataccccatgcttccacccaatatcctgaagctacgatacccagcattgatggaaaggtactcaaactaaagatgagagaaaaagtccgtccaagcatgtccgaagccaagttctgctgaataatagcgatgaaaagcgcatggtaaatggaataggctatgcctcctgtaaatgttaggcaaacaaaacctataaatgcgcttgatggtaaataactggcgctaatcagatacaatcccaatatcacataagccgtatgcatcactaatgtttgcttgcttttcaaagccttacaggcaagtactaaaccgcccaacaatgcccctgagccccaacccatttccacaactcccatttgcaaaatgtttccgttgaaatgcagaagcgtcataaaaggaaataacgtaaaaacaggcataaggacaaaagtcaccagcgtaaagcatacgaataaaggcaaaatgcccattgtacgccgcaaggtatgccaacattccgtcagttcttttttgaaatctggaagaactttcgttttttgaagagaaggaatctggacacaaagtaaggtcagacaagcagcaacagctccgatcacatctatgagcagaatatactgtatgggaagccaaacaacgaggcttgcccctacaacgggagctatcacctcactgaaggattgaatggaatggtacaaacctgataccctgacaagatggtgcttgggaaccagtagagggatgcttgcctgtaaagcaggtgcatgaaacgtactgcctattgaacgacaagcagtcaatagataaaaaaaagaaaggtctttataacccttggttatcacaataaaaagacatagggtacagaacgcgatgaacaagtccgaataaaacatcgttttctttcgattccatctgtcaacatagaccccggcaaacaagcctaatacaaattgtggtaaaaatccagctaaaatagccagagataaagctgtcggggatttaaattcgttgctaatccaaaaaataatggagaagccaacaatcgtacttgttaaaatagatatgagttggcctattcctatcacggccaaagttgatttccaatgattcattgtgctaatatttcatgcgtttatagataagtactttcgtacattaagcaaaacgaaattctatccacacaaaaaacttgtattataatccactcctgacgttggaatacaataacaaatactttcaggacgatgtaaagtcctgaaaaatcaaagtgaatggatagataaatattagtcttttctcatcggattcttttaatatcgctactcttttattatgtagtggttgtattatcttaaataaaacaaaaacacccgactttacattcttgggtgcaaaactgggtgtttgttttgcaatctgctgattttcagcgtttgttgcggagagacagggattcgaaccccgggtacctcgcagtacaacggttttcaagaccgccgcaatcgaccactctgccacctctccaagacttcttttttcaaaagtactttctgttgaaagcgctgcaaaggtacgactttattttaaataagcaaatagtttaccagtttttttgctataaaattttcaaatcgtatttttgcatacgaataataaacgaaagaaataaatcatgatataccctcagaatttcgaacagaaaataggtttcgattccatccgtcatttactaaaagagaaatgtctcagcacattaggtcaagaaagagtagatgaaatgaacttctcagaatcctttaaggatattaatgaatggctggaacaggtgatggaattcatgcgcatcatacaagaggaagacagttttcccgaccaatatttttttgatgtacgaccatcactaaaacgtatccgcgtagaaggtatgtatttggatgagcaagaactgtttgatttacgccgttctttagaaacaattcgtgatatcatccattttctgacactgacctcgaatgacgaagaacaagaaaaagaaaactccccctaccctgccctacaaaaactggcaggagatattatcgtgtttcctcaactcattacgcgtataaacaacatcttagacaaattcggaaaaatcaaagacaacgcttcttccgaattattacgcatccgcagagagttggcctcgacagccggaagcatatcacgcagtttgaatgcaattctacgcaacgctcaagcagaaggttatgttgataaagatgtaactcctaccatgcgtgacggaagactcgtcatccctgtcgcaccgggattaaaacggaaaatcaagggaattgtacacgatgaatcatccaccggcaaaacagttttcatagaaccggccgaagtagtggaagcaaacaatagaatacgggaattggaaggagaagaacgccgggaaatcatccgtatcctgacagatttctctatcataatccgcccacaggtccccgccatcctccagtcatacgagtttttggcagaaattgatttcatccgtgccaaagcccatttttccattcagacgaacgccaccaaaccatcattggaagacaaacagattttggactggaccatggccatacacccactattgcaactctcgctggccaagcataataaaaaggttgttcctctagatatagaactaactaaaaatcaacgcattctaattatatccggaccgaatgccggaggtaaatccgtttgtctgaagactgtgggattactacaatatatgttacaatgtggtatgccggttccgatgcatgaacgtagccatgccggattattcggcagtatctttatagacataggtgacgaacaaagtatcgaagacgatctgagtacctactcctcacaccttaccaacatgaaaacaatgatgaaaagctgtaacgaacgcagccttatcctcattgatgaattcggcggaggtacagaaccacaaattggaggagccatagctgaagctgtgttgaaacgtttcaatgaaaagggcacattcggcgttatcaccactcattatcaaaatttgaaacattttgccgaagatcacgaaggagtggttaatggtgccatgttatatgacaggcatttaatgcaagctttattccaattacaaataggaaatccgggaagttcatttgcagtagaaatagctaggaaaataggtttaccggaagaagtaatagccgacgcatccgaaattgtagggagtgaatatatcaatgctgataaatatctacaagatatcgtacgtgacaaacgttattgggaaaccaagcgtcagaacatccgcaaacgagaaaaacagatggaagaaaccatcgccaaatacgaagaagaactacaggaactggagaaaagtcgtaaagagattttacgaaaggccaaagaagatgcggaaaaattgatacaggaatcaaatgcccgaattgaaaataccatccgtatcatcaaggaagcacaagccgacaaagaacgtacacaatcggcacgtcaggaactgactgattttaaaaatcagatagaagatatcgagaaaaagaacaaggaagatgaaatcatccggaaaatggaaaaactccgtgaaaaacaagagcggaaaaaaaacaaaaaggataaagccaaaacggaatcttcccaactgtcaatacccaaagaacagcctatcactgtaggtagcactgtaaagatcaaaggtcaatccagtgtcggagaagtactaggaattaatggcaaaaatgcaatagttatgttcggaatgataaaaaccaatgtaaaactggataagctggaacgtagcacaccaatacagcccacccagaaaacaatggtaaaaagtaccttcgtcagcagtgaaacacaagatcgggtatatgaaaagaaactaaatttcaaacaagatattgatgtacgcggtatgcgtggcgatgaagcgatacaggcagtaacttattttatcgatgatgccatactattgggaatagaccgtgtacgtatccttcacggaacaggtacaggcatactgcgcaccctgattcgcagctatttgggaagtgttccaggagtagcacactatcaagacgaacacgtacaatttggtggggcaggtattactgtagtagacttaaaataatattttaatagaataagaggctgtttttaattaattttctctatattcgcactaaaattagagaaaattaaaagcaaaggtggcagcgggaacttctcatacaactataagtattaagcttaatgagcaagggtttcatgatattttcaataaatattatgtaactctatgcttatttgccaatcaatatacagaaaaccaagaaacttcagcagatattgtacaagattcatttgccaaactatggcaaataagagaagattttttttatctgcatcaggtaaaagcatttttatatacagctgtacgcaataaagcactcaacgaactggagcattcaaaagtagtatatgaatacgctcaaaatgtcatcgaaaagaaaaaggattccttttttcacgatgcaatcgttgaagaggaaacttatcgtatcgtttctgaagccataaataaattacctgaccaaatgaaagccattatgcaactatctctggaagggaaaaaaaacgcagaaatagcagacagactaaacatatctacagaaacagtccatacattaaagaaaatagcctacaagaaactcagagagaatttgaaagactactattacttcctcttgttctttatataaaaagacattaatttgttttttttcaaaaaaagtcgttttattattcacccaaatttcaaacagacctgttttattataaaagagataaaaaacaggtcaaaatatgataaaacaagatttctatatagccaacctcatagcaaggtatctgtcggaagaaataaccccggaagaaacaataaaactaactgcttggagagaagaatctacagcgcacgagattttattcaagaaaatttgtgatgaagaaaaccaaaagcaacatttccggaaaaatacggcattcaatccttcatccggatggaaagaagtggaaaagcgaatcaaaagaaataataacagaagcagatatatcaaaatagtaagttatgccgcaatcattctgttacctgtcctttttgtaagtatttccatgaaattcacctcgcccgtttctctttcggacaaacagttcatcgcacaatccattctacctggggaatcccaagctattctgacattggaggacggccagacaatccatataaataaagaaacagagagtctgcttgagaaaatagacggagcccgagtccacatggactctacaatgctgaattaccaagtaacatcaaaaacagccccaaaaaacaagcctgtatataataaagtggaaactccacgaggtggagaatatgctctattgttaagtgatggaacaaaagtgcatctgaacgcaatgaccagtctccgctttcctgtgacatttgataacggtccacgcaaagtggaactggaaggcgaggcctattttgaagtctgcaaaacagggcaaccatttatagtatgcactcaaggcatgcaagtagaagtgttgggaaccacattcaacatctctgcttatccacaggaagagtatcagacaactttggtaaacggttctgtcaaagtaaatacagaaactggagaaagctgtattttaaagccttcccagcaagctaccatcagcctcggaaacagcagcatacagatacgcatggtagatgccggattttatacttcatggataaaaggaaaaattcatttcaaagaccagcgattggaagatatcatgaaaatactatcacgctggtatgacatggaagtaatttttgccaatgagaaaataaaagacctacgctttggatgcaatgtagatcggtattcggaaatcactccatttgtacgtttgttggaagagactcaaaaagtacacgtaaaagtcaataacaaaacaatcacattctataactaataaaaatgatgtattatggacaaaaaacacaactacaccaatcacggtaaaagtagtaaacgtttgtggattacgttcctatttttctgtatcattaccacaggttttatgcaggctgccaacaaagtgtttgcacaagccactgtcacagcctcattcaagaatgccacgttgagtgaaattctttgggaaatccaaagacaaaccgactttacttttgtatacagcaccaatgatgtaaaacaaataaaagtccaaaacctaaatgtaaataacgaaaaaatagccaatgtgcttgataaatgtcttatgaatagcggtttgacctattcagttcacaacggcgttattgctatcaagcaaattgaagaaaaagagtctgctgttcctcaacagaaaacaacattaaccggtacagtactggatgagacgggagaacctattattggagcgaatatcttagtcaaaggtactacgaatggaactactacagatttggacgggcacttctcattagatgtagaccgtatacctgccactttgattatctcctatataggttatggcaagcaggaaattaaagccactgccggaaagatactgaaagtagtcatggctcctgataataatgttatggaagaagtggttgttaccggttatggtactttcaagaaatcggcatacgcaggttctgcttctactgtgaaggctgataaaatgaaagatattccggctgtttcattcaaagatttactacaaggtaatgcacccggggtacaattcagttcatcgtcaggtcaaccaggagcttcttcctctttgaatattcgcggtatgggatcttttaatgccagtaattctccattatacgtaattgacggaattcctatgcgttcaggttctatcaatacgatgagttcagatgcaggtcttgacattatgtcaactatcaatagctctgatattgaaaacataacaatcattaaagatgccgctgccgcctctctctacggttcacgtgctgccaatggtgtagtacttattactactaaaaaaggtaaaagtggaaagccacaaatttcattcaaagcagattggggtagttctgatttcgcaatggattatcgtcctgttatggggggagaagaacgccgcgaatatatttataacggtctagtagccggtgcgttaagagacggaaatagtcacgacgaagccatagcatatgctaatgaaaatattgacgattatgctcctgttccttggtgtggatatgtcgattgggatgatatcatgttcaaaaaaggaaatcaccagacttatgaagcctccatttctggtggaacagacaaattcaaatattattcatctatctcttacctaaaacaagaaggtattgctatcaactccggtttagaacgtatcagcggacgtttaaatgtagattatcaagcaactgataaattaaaattaggggcaaatatgttatttgctaccgttaatcaagatgtatatggtgaaggtacctcctacacttctcctttctattcatcacgtaacgctgttgtcccctcagacacaccatacaatgaagatggaagctggaaccgcgattttatccgcaacggtgatcgtaatccactattatctgcaacttacgactatcaacgtgaatatgttaatcgtgctttcaacactatttatggcgaatatgaatttattaaaaacttaaaattcaaatcaacattcagctatgactacaccaacactaaaggcaaggattggagtgatccccgcacttccaatggtgaggatgtaaatggcggcatgagcaaaaaattctacgaatacaagaaaatggtatgggcaaaccaactgagttataagtttaatatagccaacgatcaccattttgacgcattggtaggttatgaaattgatgaccaatatcgtgactatctgtcagggtatgcaactaatttcgctacagcagacaaagatgaaataagcaatggtatgaaaaccgaatccgttggtggcagctctaccagaacccgcatggtatcttatctgacacgtgtaaactatgactataaaaataaatattatctaggtggtagtttccgtactgacggtagttcccgtttgcataaagacagccgttggggtagtttctggtcagtatctgccgcatggcgtatgattgaagaggaattcatgaatccggccaaaggttggctgaccgatttgaaaatacgcgcatcttatggtgtcaatggcacacttccatctgactatttcggatatatgggtttgagtagtttaaccaatggttatttggaacaaccgggtattatccaatcacaaatcaaaaatacagatttaaaatgggaaaccaattacaaccttaacttaggtctggatttcagtttgttcaatcgtataaacgcaactttggaatactacactcgtactactaaaaatttgttgatggatcgtcctatctctatgacaacaggtttcggcagctatcttatgaatattggtgaagtaaaaaataagggagtggaattggaaatcagttcgaccaatataaagactaaagatttctcttggaataccactttcaacatctcgcacaacaaaaatgaaattgtgacattggatggcatgcaaacagaaattatcagtggtacccaaatacggaaagtaggaaaatcataccgtacattttatatgatagagttcgcagggatcaatcccgaaacaggcgctccccaattctataccaatgatttggacgaaaacggcaactatataaaagagattacagaaaaatatagtgaagccaatgctattgtattagataagcatgcagagcctaatgttatcggaggtttatcaaatacattacgctataaatggttcgacttaaacttcatgttctcttaccaatttggcggttattcttatgacaattgggcacaaaaaacagagcatggtggtaacgacctagaagcaaatataccaacctattatcgcgatagttggaaacaacctggtgatatcacaaaatatgaactatttattgaaagtcctgatgtagcgatgaacaaatccactactactcgcaggttacacagttctgacttcatccgcctgaaaacattaacttttggaataactctgccccaagtatggacacaaaaaataggagttaacaatgtacgtgtatatgcttccgcaaacaacctttggacatgggctgcttatgattattatgatcctgaagctgtcagtggtggtagtgccatctggggaactcctcctttgaagactgtaacctttggtctaagcgttaatttctaacccattaaaaacttgaattatgaaagtatttaaatatttatttatcagttccattatgtttgccgtcacttcgtgcggaaatgactggctagatctagccccctccacacaagtggatacagaaaccagtatcaatgttttgtcagatattgaattcacattgaacggaatctacagcacaatgcaaagttcagatgcatactccggccgtctggtatattatggagatgtaactggagatgacatgcaggctgtaagttcaacgaaacgaaccggtaattattaccgtttcaattttactaaagacaatggtcccagcagtcattggtcatatctgtactctattatccagaactgtaatctgattctaatgaatgttgataaactatctatagatgaagatgaaaccgaatataaaaatgatttgaaaggccaggcattagccatccgtggtatggcactattcgacctgacacgtatttttggttatccctacctaaaagataacggagcttcattaggcgtgcccattgtgaaagagttatcaactatagacagtaaacccgcacgaaatacagtagccgaatgttatacggaaattatttccgacctcaaaaacagtacagagctgttgagcggtgattttaataaaggaaaagtaaacagatgggctgctatgacattgttgagccgagtatatttatataaaggagaatacaatgaagcattgaccatggctgaaaatgcaataaagggtgcagaaaaagaaggctacgctctttggacaaacgaagaatatccaaccgcatggggcaatgacgcatcagcatccaatcctggtgaaatattattcgaaattgtcaatctgactacagacagtccgggcaaagaaagcatgggatatctgaactcatacaacggttatgacgatatgtgtattacttgctctttttatcaattattaaagaaagatcccaaagacgtccggttgaaaatcttgagttttgacaaaaagtactacgcatacgtcaataaataccaacctcagcaaggagaaaacataaccgatgccaatattccgcttatacgcctttcagaagcctatctgaatgctgctgaagcggccgtacagacaggagataatgccaaagcagtgaaatatttgaattccatagtacaacgagctaatccggaaaattcagtggaaggaaaaacattaacattagaaaatgtattagacgaacgtcgtaaagaattggtagcagaaggacatcgtatgtacgatgttatcagaaatggaatgactgtcaaacgaatcgatgtgaaagacagtgatataaacaaaaccaaacataatactgcttacatggaatatgactggaatttccataaaattctacttcctattcccaaaaaagaaatggacgcaaatcctaatatgaaacagaatccaggatatgtcgattaaataattcaaataccaaatcgatgacaagcaagactaattttatcaactactttcttcttgcatttaccctcgcattcatcagttccggccttagtgccggaactcttgatttcaaagacaagaagaaagacaaagagaaaaaagaagaattaacagccgacggtccatacgtattgtatcagcctgacggccaaatcagagtaatcaatgtagataagaaagggaatatcattgataccacttataccacattacctcaaaactttaccctgcatgtgacagaccacaaaggcaggtttccatttgatgtaaaactacacccggtaaaacgtcccggatggaattatccccaggcagacaaagtttttgtcatgtccgaccctcatggaaggctggactgtgtaatcagcctgttacaaggcaatcatatcattgataaagactacaaatggagcttcgggaaaaaccatctgatgattatcggtgatatttttgacagaggaaaagatgtaccgcaaatcttctggctattttacaaactggaagaggaagcagccaaagccggaggacacgtatcgttcatactgggaaatcatgaaccgatggtgctggccaatgacctccgatacaccaaagaaaaatataaaatattagcagaaaaactaaagatggagtacccccggctattcggtcccgataccgaactgggcagatggttgggaacccgtaacaccatgcaaatgataggtaacgacctatatgtacatgccggactgggcaaagacttctatgacaagaacttgagcattcccactgtcaatgaagaaatgagtaaaggactatttatgacgaaaaaagaacgcaaagcgctttctccactcacagccttcctgtatggaaacagcggtcccatctggtatcgcggactagtacgcaccgatggcaaatacaatccgctggcaaaagactccctagaaatgattatggaccgttataaggcaaaacatattattgtgggacataccattttcaaagatatttccactttctataacggcaaggttatcggagtaaatgtggacaataaagaaaaccggaaaaaaaagcgcggacgtgccatgctgattaaaaataatcagtattttgtcgtcggtgacaaaggtatacaaagacaattagaataaagacaatacaccaaatcctaccggtggttttccaaactctcctgacaactttcctatttgtcaagagagtttttcttttccttttttgctactttcccccttttattttatacctttgttcctcataataactaaccttataaaacgaaatgaaatctatccgagaactataccgcatcggcaccggtccgtccagcagtcatactatgggaccgcgcaaggctgctgaaatcttcttaggaaaacatcccgaagccaaagcttttcaagttactctttatggaagcctcgccgctaccggtaaaggacacatgaccgatgtagccattttagatacattgcaaccgcatgcgcctacagaaattatctggaaagcccatgtcttctatccgtttcatcccaatggaatgactttcaaatctttgaatgaaaaaggaaaggtgacagatgaatggactgttttcagtgtaggcggaggtgctctagccgaagaaggacacgacaaaggctcaactccggaaatctatgatatgaaccgtatgagtgaaatcctctactggtgtgaacgtaccgggcgcaattactgggaatacgtccagcaatgtgaagacgaagacatttgggactatctggcagaagtatggaaaaccatgagagaagccattgagcgtggtttggatcaagaaggcgtattacccgggccactcaatctgcgcagaaaagcctccacttactatattaaggcaaaaggttataaggacaatctgcgttcccgcgggttagtattctcatacgctctggcagtcagtgaagaaaacgcctcaggtggcaaaatcgtcacagcccctacttgcggatcatgcggagtggttccggctgtactttatcacttgcaaaaaagccgtgacttcagcgatatgcggattttaagagcactggctactgccggattgataggaaatatagtaaaacacaacgcctccatttccggagccgaagccggttgccaggcagaagtaggagtggcctgttcaatggcatccgccgctgccagccaattattcggaggtagcccggcccagatagagtatgcagccgaaatgggcttggagcatcacttgggaatgacttgcgatccggtatgcggattggtacaaatcccttgtatcgaaagaaatgcctatgcagcggcccgagctcttgatgccaatatctattctgcctttacagacggtaatcaccgtgtatcctttgacaaagtggtggaagtaatgaaacagaccggtcatgaccttccttccttatataaggaaaccagcgaaggcggtctggcaaaggattacgagccgatggattaataacagggcaaagaccgagaactgtatttataatacataagagggtgaatcaaaattggttgcgactatctttttcaacgctgataataaaaagatagttcaatttatttctgatacaccctcttatggcatcattactataaggagagatagttcccctattacagaaaaaatcttttttaatcgctcaacttcaagaatcctccaaactgatcgaagtctacttccaatccattttccaatgtcagttcatatcccttgcggttacgttctatcttcaccgttttatgcccgttataattagctttcatatacttggaaatagcctgagggataaaagtagaaggaaccgacttgttcttgcaatctatctcaagccactctccctttgaattgaactccaattcaatgccatcggccaattttacatcataggaagtggtctgaaacaagtccttttcaatcttgatatacgcaactttagtctgggagaaatgtttgccgatcatttcacgtgcggcaacaggaagcttattcacatcgcgggtcacaacatcgccagccatggcgaattgaagagagcataccagcatagccattaaaaataaaatctttctcataatctaatttattctttagttagttaatgccataccaacaactaaccgcctaaaaagattatgacgcgaaaaattattcctgtattttagatttaattaaggctgtctcccaacatgggaggaagctcctccatatcctcatttttagatatgctcatttttccttcaggagtaatagtgatggagaaaggaatatacaaatctgtctgaggataactcacactggcagccaatatgatattttttccctcacgggtcttctcttcatcaaataccacgccctccaatataaaatgacggagatgatcagcacttacgaatccagagaaactttgcttggtaaaagttttggcaaagacccggctcccattttcacgggaaattctaacgatgatacgattgtcggcaaaaattcccaagtcacttttgactgaaggcagagaatcactgggagcacgctctataaacaaattatatttttttccgccactgacaatatgctggtcaatacgtgaaacctgcatacgctgcaaacctgtcacatgatccacactgtctatttggaacatcaattgttctgcatcaacggaagcctctttcttacctccgcaagcggtcattacaaccagcaaaacgacaaataaaaaatatatctgtttcatctaaatctcgatttctaggtgacaaagtaacaaaaagtaacggacactcacaagaaaacctccataaaaagcgaaaaccgggcaatatcacattggccggccttcagagaaaactaaaaactaaactaaattatttattaagttagactaaacccaaaagaaaaggtttaatctcacttagaaaaaaatattctttctttgaaaggcattcctgctacaacgccttccaaaaatccataaaattcttataaagcccatagcagaccaactgatcttcctcctccaactcataattttcctcaaaatgattctccacctgatgctccaatatcgaaatacccaaaccgttcagcactttctccccttttatcaatgcaatgatttttatattgaattccgtttctaatgacagatcactcaccttatagcctacaaaacaagaaggaagtttgaacttcatcacataatgttcctcgtcaatctgaaaagactccacattgacgtgtaaatccaacaactgaaccaagctccgtgccgcttctttctccggtgtcagaatactatctaaattaaaagcctcaagcacggtcttatgcacatcatctaccgcacgggcatagatatgtttcactcctttctttttcagcagtgccaccacacgcacagaagcaccaaaattctcgccgatagcaacaataaccacatccacatctttcagtggcagcacactgagcgattgttcgtccgtagcatcaataataaaagaagtcgcgattttgtccttcaacacatccacacgatgctcgtttgtatccactcctatcacctcatgtcccaatacggaaagctcttcggccaacactccgccgtaatttcctaaaccaataataatgtatttcataactagttgattatgatgttatcactcggatatttatattttgttatttttttctgtttaataaggctggatatcaaagtaagcacccctactcgtccgataaacatcagaacaatgacaatcagtttgctgtcacttcccaaagtaggtgtcagatccaggcttgaacctaccgtactgagtgccgaagtacactcaaaaaccaacgccatcactgaagcctgcggctctagaatgcttaaaccgaagatacccgcgaaaacaatcagcagataaagaatcaatgtggcattagaacgccggatggaatcatgagataactccctgttgaaaatattgactttatcggcacctataagaatagcacgcaagttcaacatgactacagcaaacacattcaccttcacaccaccggccgtagactgcgtaccgccgccaatcatcatcagcaccaccatcagcagcaacgtctgcacactgaaagtagtcatgcccacacttgaaaatcctgccgtacggggacaagttgcgttaaagaagccctgcacccatttctctgtagccgtcattcccgcaaaagcatgattccattcgaaaacaacaatggccacagtacccgtcactagcaagatagccgtcataatcaatacgatacgggtattcaggttatataaatgtattttacggattgtcctcttattctttttgacataacggtgatacaagcgcttgctttcataagaaaccgtttcatacagatttaccagaatcgggaaacctatacctcccaaaataaccaggaaagagatagtgatatatagcaagttatgattatgaagtaccagttcgttacctaagtttccatacaaagtagagaatccggcattgcaaaaggcagagatggaatggaaagcagaaaaagccagttccacctcaatatccatgcccatagtgccatgtatacttaaaaaaataacccccatcccagcagcctctatcaccaaggtaaaccctaatatatataataaggtggaaagcagcgaactgagtgactgcgagcttaccatatcacggaccaccaactgattgtagagcgaagtattccccataaaaaacatggcaaagaaactggtcagggtcatgactcccaaaccgccgatttgtatcagcatgataatgatgaacaacccctcggacgtgaatgtagaagagacatcgaccgaaaccaaccccgtgacacaaatggcactggtagcggtaaacagagcatcgataaaggaaatgccatgataagtggcacgcggaagcatcagtaacgctgcccctatcagaataaatatgagaaaactggatgcaaagatcaaagacgggttggtgcgcctgcccagcagccggactatcccattagacaattgcagcagcgaaagcaaagtgagcagcaccacatgatataaacgactgtggaaaaaagaccagaaatcatgaattcccccttgcacctccggttcatggaaaataaccggaatcaaagtcagataaagcatcagactcagtatccatgccagtccccggtacttccgcttggtatccgagtaatttaataaaagatgcagggaaatatcaaccagaaaaacaatccagacaaaatgatacagcgtgtttatcatctccatttcttcaaaagaaataagaaatccatgctcataaaccaatgtaaggatgaacaaggccgacatcatataagttatcccgtccatccatttcagcaatcgctctatgtacggttttactaacttcttacgatagataaatagtttgtgtaaaggttccatgtcgatatcatcttgcattaacagaaaacaaacttaatcaaaatattcacatctctgcctataataacaaataacttcgcatttttactctgacatccctttttttattgttcccgacaaaaaagcagttgaaaattagtaaggaatactttttttacctaattttgaccgcaaaactattaaattgaaagattatgagcacaaaacagaaacgttttatcttaccagaggatgaaattcctaaatactggtacaacatacaggcagacatgaagaccaaacccatgccgccgttgaaccctaaaaccaaagaagcgctgaaaccggaagacctctaccccatttttgccaaagaactttgcaaacaggaattaaaccagacagacgcatggattgaaattcccgaagcagtgcgtgaaatgtacaaatactatcgcagcacaccattggtacgtgcctacggactggaaaaagcactagggactcccgcacatatttatttcaaaaatgaaagtgtcagccccatcggctcccacaaactgaactcggctctggcccaggcatattattgcaaggaagaaggcgtaaccaatgtcactacagaaaccggtgccggacaatggggcgccgctctatcgtatgccgcaaaggtattcgggctggaagctgccgtttatcaagtaaagatcagctataatcagaagccctatcgccgcagcatcatgcagacattcggagcaacggtcaccgcctctccatccatgtctacccgtgccggcaaggatatcattacccgtaatcccaattatcaaggttcactgggaacagccatctccgaagctatcgaactggcaatgagcactcccaactgtaaatatacactagggtcggtattaagccatgtcacactgcatcaaacggttatcggtctggaagccgaaaagcaaatggaaatggcaggcgaatatcccgacatgattatcggttgctttggtggcggttccaattttggaggaatctgcttcccctttatgcgccacactatcctgaatgggaaacaaacccgatacattgctgccgaaccggcttcgtgcccgaaactgacccgtggtaaattccagtatgactttggcgacgaagccggatataccccgttgctgcccatgtttacactggggcataatttctctccggccaatatccatgcgggaggtctccgttatcacggtgcaggtgtcatcgtttcacaattattgaaagacaatctgatggaagcggttgatatccagcaattagaatccttccaggctggttgtttgttcgcacaagcagaaggaatcattccggctcccgaatcgtgccatgccatcgccgccgctgtacgcgaggcgaacaagtgcaaggaatccggtgaagagaaagtgatcctgttcaacctttcaggtcacgggctgattgatatggcctcatacgaccaatacctggcaggtaacttgatgaattatgagttaaaagacgaagatatccagaagaacttggatgaaataaaagacatgtaatcaggacataaaataaacgaaggatacggaaaggatatattatcctataaactacggcaagctaagcggttgtatccttcaggttaagggttcttttactgacaacttctatctcccaaacttgcggagttaactccatagcctttggagttatctccataagcttgggagttaactccaaaggctatggagatagaaaggatacgttagtttaagcttagggataggatagaaaaggcttaaccatacaatgaaagacacaaaccactctaccggcgggatataacattaacataagttcgatataagaaataactcgttacaggatggttttgagttaaatgacaaaaggattattaaaattcaatatcagtcttgctcatattcctgtcagttataagctagtcttataataaactcatgttatcataagaaaaaatccgcgttatcccgcacaacccacacctaaaaaatgattcaaaaccacaaaataacaggcacttcaagcctgtttataaagaaaatgaactattttacaggattatgtatgaaaagtacaaattaatttccctttttattcctttctttgcacagttacatcaataatccaaataagtatgaaaaacatcatgaagcttttcttgtatgctgcattacctttggcattaattgcactaggcagttgtagctaccctaaaaacatcacgttcaaagccgactcacaaacaggggcgctaagcggactttatctgacaagcgacacttccatgaactggatcctgcgtacggatggaacacaatacgaatgggtggactcccggtatggatggggattgggacatcttcggataaacggcactgaatactcctggaatatcccgataaaaaaacatgacacgagccatcacatgaccgtgaaataccagacaggtgacatagaaataaacgtagcccgaaaatggaacagggacgggaacctggtagaatcctacgaattcgtaaacaccggagaaaaagacgccgacttacaggacattgccatcaacacacctttcaatgacaattatccggatgcccagacttgctacgaagcccgttgcaatgcacatatatgggcaggaggaaatgaagcctatgtctattgcacccggatgagcggagcccccggcggattgggactgattatggaagaaggtgccattaaaggctatgaagtgagggagcgctcgcagaaaaaaggaagctccaacttccgcggtgttttccaacttaatccacaggacaagactttaaagccgggagaatgttataccatacaatggttactcctatcggcggacaactgggatgaattccaagcaaaagccatagacaacggtctgatcatagcctcagcagaccgttatgtagtagaagcaggcgaaaaaataaatgtttcgttcaaaagcaactgcccctcactgaaaggcaagctattgctgaacggtaaagaagtggcagaagtaagcggtgacaacatcaattataccaccataataaatgaacccggagagaagattttcacactggcctacgggaacggaaagcaaacgtcggtagagtgtcttgccgtcagcaactttgacagcctggtcaaccaccggtgtcagttcattgccggacaccaacagttcatcaagcccggtgaccctagaagcggtgccttcattgtttatgacaacgataccgaatccctttacatcaacggagaaagtggcagcaaacgctctgactgcgacgaagccagagaaagggtagctatggggattctgctggctctacaataccaacgtacttccgacaaaaaattaatggatgccctgaacaactacgtatctttcatccgccgcatccagaaaccggactacacaaccaattccaccgtagacttcaagagcaagaaccggggatacaactatccgtgggtggccgatttctggtttaccatgttccgcaccacaggcaataaacaatatctgaaagacgggtacggcacactgcgtgcactggtccgttatttcaagcatggtttttattgcatcaatatcccgacctacggctatactctattgaaagaaaacggatttactgccgaagcggacactctgctgaacgatttcaaatcaatggcagacgtattttgtgaaaacgggcctaattatccgacctccgaagtcaattacgaacagagcatcgtagctccgtccattatccatctgctgaatgtatatatgctcaccggggatgaaaaatatctgaaaggggccgaaagccagcttcctttattagaatcatttggcggaaaacagcccagtttccacctttatgacatcgctattcgtcactgggatggttattggtttggaaaagaccggatttggggagataccttcccacattactggagcactttatcgggtattgccttccgtctttatgccaaagcgaccggaaaacaagaatatgcagaacgggccttgaatattttccggaacaatctatgcctcttcaccgaagacggaagaggaagctgcgcctttatctatccgaacaaagtgaacggacaaaaagctcatctttatgacccgtttgccaatgaccaggattgggcaatggtattttggttggagtatggcccggatttcaagtaaatgaggagatgccgaaagtccgtccgatagtgctgtcatgtattcagctgtaggggcagggattgtctcatagccgtcaagcaaaggaaaaacatctaccgtagaacaccgacccaaaagggtcggtttcttcattttataagttttagataacagtctgcaggttcttccagagttccgcttctctcccgactttatcgtcaagaagctgcttacaagaccacggtcggtcatactttggaaagagaacctgcaactgctttcgtactatcaggcagatacacgagtctgcccctacggtggtgaaaatactatttgccaactcagattgacgaatataagtttttttgcctgcccgaaccaacgggcacgatcttgggagaatatgcaaatcagcctattttcgggcgagcaaacctcgcccttacaagcaaaatgatagctgaattccttaaatatgttttcacccagccacaaactatgactcaaagctgcgaagcattttaatctcgtcccgccaaatggtgtcatcgggagtttcaagaataacgggcatatcgtcaaaacgggaatcctgcataaagcggcggaagaaatcaataccaatcagcccctttccgatactgtcatgacggtctacccggctacccaatggtttctttgagtcattcaagtgaatggcacacaaatagtttctccccactacctcatcaaactcggtaaagacccggtcatattcattcacaatatcataaccggcggtataggtatggcaagtatccaggcaaactcccacacgagatttatcctccaccttatctataatatatctcaaatgccagaattcatttcccacattacttccctgtccggctgtattctcaatcacagcagtcacaccggtcgtcttatccaaagtcatattgacagactcggcaatcctgtccagacacttctctatggatatcttgttcaaatgacttccgggatgaaaattcagcattttcaatcctaaaagctcgcaacgctgcatttcgtccaaaaatgctgcacgactcttctccagcccttcctcgtcaggatgtcccaaatttatcagataactgtcatgaggaagaacataccgggcatcaaaaccttctttctcgcagttttctttaaacagagtaacactctcgacagacaaaggttttgcaatccattgcctctgattctttgtaaaaagagcgaatgcgtccgctcctatccctaatgcattaacgggggccatttccacgcccccgcttacggatacatgtgcacctatttttttcattctctttccattattgatagacacaaagataggaaaaataagttagaaattatattgcgcactcaagtttatacggtttacttcacggttcacatcattaaaattctctctccaaccatgaagatattccgcacctacctgcaagttatgacttacattccagaatacatttgcaaccaggtactgaccttttttatactgagtttcattaaagtgagcatagcaatcttctgtaaacagacgtgactggctatacgtagccgatgcgaatacccgtttcgagaaattatactgtaatccggcataccatcctttcatgggcagtacctgcatacgtccggactcatcggccaaaggaacgatatctacattcaagttgctgatatcattcaaatattgagcaatacctctaccataagtatattgtccgtaaagctggaaaccacccagtcttgctgtccccgatgcctgtatcccccaaccggtcaatgactttgccttattattcacttgatcctcataagtcatacttctcaagattcctcccacacgtatatgactagcctttgcccaagaatactgtacataggcaggaatatccggcatcctctgcttaccgattctcacatcttgtgccggagtaccgtctactgacggcatttccacaccgacacccactttcaaacctttcatcacattggcttcataacgcaactgggtggcgcgatagaaagtcatcccgtcaggtccttgaaaatcaatagtcggaggagctgcggcaaggtccataaacaatccggtatcataccccatagtaaagcccaggaaggataaataagcattctgcaattcaaaagtctttccacttccacggaagtttccggctgtataaacgatgaagttacccaaatgcttggttctccccaccaactttaaaaagatagtggaagtgcttgcatccatctggaactgattacggacagacgtggatcccggttgcggaatgagtgcagggataaagtcaacatcatccactatcccattaaaatcatattccattgtagttttcaaataaccaccgatacccaatgcaaactttccctgttggtcagtaagtaaaaaacgaggagcacggggatcatggaaatgcggacgttgcgtttcttcaaatacattgattaattcttccttgccatttttatcttttgagataataacaacaggtcccggtccttccagctccggataaagttttttttgttgcgcaaacatcgacgtaacaatcattgcgcccaatacaaggcaactcattgatttaaagatacttttcataaaagttaagtttaggtaaatagtcaattcaatggactatgaacaaaaagtttagaaaaaagtttgggaaatgtttgcaaattcaaaaaaagtcactacctttgcacccgcaatcgagagagaaatcctcgataaaaaggatggcccgttcgtctatcggttaggacgcaagattttcattcttgaaaggggggttcgattcccccacgggctaccaaataaaaaagccatcgataaatcgatggcttttttatttggtagccctgctttgtgcagggtatccggcggctcagtttgaaaacgggtcagtcttaaaatttggaccactgacccaaaactgtaagcgtctccgcgattctatcttgtcgcccatttttcattcttatatttttgccgctatgtttctaattataagtgaaatatatttattcttatttcgaactcacgtttaatacaaaatcccatcaaaaacaccggtccgattctcataagtaataagtaaaaacagtattcaatatggagacaaaaatcatatttttccctcacttatgcctgtaacgcctctgttcctaaaaacacatcagacatagcgcatcagtcatcccccaacgggacagccgagaaactcttatattccctggtctgccccatcacaaccacaggattctcaaaggtttcatatatgctcaatactgaagaactgatcctgtcaatctgccagtagcagtaatccagaagaagatatctgttattgggagtgataaaatcatatcggaaataatgtacatgctcttccacttcctcgccatcacacgtcgtccgtgatttacaggaagccttaccattcagcccgaactcataatgttcacagacttccgcatccctgccatcctcagtacgtatctgaaatgttctctcccatgcataaccggtcagattggtaacaatggtattgctatcctccccgtaatgttcatcaatacaacctgcaagaaacagtacacatataactgtcgagcccaataatccaattaatgtttttttcatagtccgtcacttttttattttattgtcatctgtaatggagtacaatccttatattggtcccatcacctgcaccttgctccttccgcttccggtcttcaccacctgcacctgcgcagggatacgttccatcatctccgccacatgggaaatcacccctatcttacgcccttgcatctgcaaccgctccaaagcatccatcgcaatgcgcagagtgtccatatccagcgatccgaaaccttcgtcaataaacaacgattccacattcatccggttggaggacaaggaagacaagcccaatgccaaggcgagagataccaagaaagattccccgcccgaaagggaatggacactacgcacctcacccatcatatcaagatccacaatctgcaaggccagcgtatcagggatgcgttgcagttcgtaacggggggcaaggtcttgcaaatgcctgttggcataaagcaaaaggacatcaagcgtataaccttgggctatttccttaaacttggcgccagtctgggaaccgaacagttcgttcagtttcgcccaattctcgtagatagagtttttttcctccaactctttctcgatgccggctatgcgttccttaccttttatatggttctgtatcgtcacctctatttgggccaaacgtccggtttccatttctttagcagcagtgcaggcagtcaatgtttcaatcagcgactccttgttttccgtggtatccggtttcagaggagcttgctgatgctcctcccttttctgccttcgctccgcaaggatcgcctgaagagtggtttccttctctttcagtgtgcccaacgcttgtttctcagccagtatccagcttttgtctttggaaagcaattgttccaactcggcatacgtttccttttgaagcgtgagccactcgtttattttcaattcgtcttgttgcaagacagcagtcagacggactaattccttttccatctgtgcggtctgccctttgtaagattccgcctgcacagttaaagaatgatgcaagttcatggctttttccagttgttgttccagttccttttgccgtcttgcatgggttgcaaccactgtttcggtggattcaccattcagcagggaagaccgcagacgagcacgttcgttcaattctgcctgctgtctttcttctttttgtttcttttcttcgtacaaaccaatggcattggcttcttcttttttcaaactatctctttgggctgattttgaggtaagagcctcttttatttcggtctgctcttgcaaacgggcattccattgcctgccgaattgctggacataatgtttcaatgtgccctgctccaacaaatctttccaattgggaataatggatacgtatgtttctacttttttcagcgtatcatcaacttgcgccacataattttcaatcaatgcagaaagacgggccatctccagttggcgggcattcagcgtgtttttcagttgttccgtttctttagcaacctgttctttcgcacggttcagttcctcttcctgcaaggattggacattggtctgttccctcatcggatgatggaaactcccgcaaaccggacatggctttccttcctccaactgctcacgaagcaacagcgcctctgccggcaacagtcggttcagacgctcggcttcctgttgtaccgatttcaaccgctgttcctccgcttcactcgctttctttactttatccagcagttgacggttcgatacgctttgcgcccttgccatttccagattggtaagcaagctggtaatcagttcaacggcaggaatcaattgggaataagcggtatatcgttcaaaccaggtttgcaaggcggtttgcttctccatcaacaaacttatatccttctctgtcttacaaacggattgatgcagattatctttagcctgcaatgccaaagccgcttctttctgactttccgctaattgctttctattttccaccaactgcacatccaatgctctggctttatccaattgcggttcttgctgcgacaaataggtcttaaattccgccagttctttctgagcggcttcccactgcacgttcgcggaagtctgtaaagccgcattctgccggatggcaacctctatttcgcctaaccgggaacgaccggcatctatctgcttccgggcgttacgctgttccatatacacatcgcggatatcctgagcctgctctatacgggccaacagttcataacgtggacgggcggcttctatttcttttctgatgccggaaagtgattcttccgcctgtatgcatcctgtattcaagcgtccttcttcttccagccatttcaacttgccggacaacgcctcctctttcttcttcgaaacggacaagcggacttgtaattcttccttttcagccgaaagttgctgtaattgctcatctgtcagcaactcaatgcctttgatacgctcctgcaataatttatattcgctttccgcccgcttggtgcgttcatagatggaagcagagatacgcgagtaaatttccgttccggtcagtttttccaagatttcggctttatcaggctgacgagccttcaggaaggtagcaaaatctccttgagccagcaacacagagcggttgaactgttcgaaagagagtccgatcagttcactgatgcgggataataattcggtcttcgtcccttgctgttccactccggaggtaaggttggtcaacgtcatttccactttttgcaaggaaccgctaaccttcccacgcgaacgtcgcaccgtccaacgtgaacggaacacctctcctgtcaaagcgacgaaatccacttccgaatacccctcggcagtaccccggcgaaggatggaacggctatcgttctgtgcaattcctctgtcggcaacatccatgacagagacgttattctctttcgccttgttcatacgtggcgtacagtcaaacaaagccagacacaaagcatccagcaaggttgattttccggctccggtactgcctgtaatggcgaatatacctgccgagcacaaaggttcgacggtaaagtctatcataaattcaccttccaatgaagccagattctttcctcttatcgctactattttcatactcctgcctccttgattacactttccagcaattgtttcatggtatcgggcatctccgtccctccatatttccgtttaaagacatccagtgccatatccagcggacggatggtttgcaactcctcgtaggaagtggcgacaatgccgcttgcctttttttgtggaagcatagcggcgatgcgtgccaggcggactgcttttcctttcaacgcttcctctatcttatacttataagaaggttccggctcggtcatcaaaatctttatttccagatagggcgaccgcaacgtgacatccccatcgggcaaatcgccgatggcttgcagcacttcttccagcggacgggcctgacgaggaatactcatcacgccggctagcggttcaaatgccaatctctctatgccggtaccctcagcacttatcgttatcatgaccactcccgaagcattgttcctctcagcaaaagacatgggcataggagttccggaataacgcacattctcccgatgggacacacgctgggagcgatgcagatgccccaatgcagtataggcgatagcctcatcaaaagcatcgggggatacacattccaagcctccgataacggtacgttccgaacggtcgtcctccgagatttccgagccggtggcttgcagatgtcccatggcgataacgggaagtcctttctccttcacttcattgaaaagctgctcataaagcagttggactccttttgagtaattttcagccgaaggataatccccctgacgcagataggggacggcaaggcaataggcggtcacttccccttctgtgtaaagggggacaatcaggtgttgcaagtctatatcaccttccgcattgcggcgcacgacaccgcgaacggtgacattcatatcctccaacaggggattgggagcctccaaacgggctgccgagtcatgatttccggcaatgatgataatttgcaaagaagggttttcggacgtaacttctcttagaaaacgataatacattcgttgtgattccgccgaagggttcgggctgtcgaatacatcacctgctatcaacaatacatctatttcatgctgtcttatctgctgtttcagccattctagaaaatggagatgctcttcccgccggtcgtattcataaaaagtctggcccagatgccagtctgctgtatggagaattttcattagctgttcggtttgtttcctgcaaaaataggaaaactaaatgaaaaaaggtatttcttttaggtacaacctctaaatgaaaactatttttcatgcagaaaacaagcagacatgccaccttttcgctatctttgccatacgagataaataataagaagaaaggagaacgtcatgagtacaatcacattggaatcaatacaaaacgaactgattcgggaaatcttggacatcaagaatgtaaaggtgttggagtctgtaaggaagactcttgttcatgctaaaaaggaaatggaatctgtttctaccatggtggcagaggatgaagaaccctacatgaccaaaagtgaaataatggacgggctgtccgaggcttgcaaagacatcaaactgatgcgtgaaggaaagctgaaaggccgtcccatagaagaattgctcaatgaactataaaatcaaagtatatcgccacttcgaaaaagaagttaagaaactttccaagcgatataaatcattgaagcaagacttgacaattttagccgcagaactcatgcagaaccctgacatgggtactgatttaggcaatggcctacacaaagtacgcatgagtatagcatcaaaaggaaaagggaaaagaggtggagcaagagtgatcactctcatcgccactctatccaaagaagaaaaagagattggcttacatttcatttatgataaatcagagcgtgagaatatcactgataaagagttacaagcggtcttgaaagacaacggaattatctgaaaagacgaaccggtcatgccaactgaggcatggccggtttgtatatctatcatcattcagtcaccagccgcacctcataaatatgcggagtcactttctcatttcctttaccgatctttatctccagttgctcattggattgcatagatgcaggtacatcaaatatcccaaccgatacatccgaagccggtttaccagccaatcgtcctacttcctgcccgtttatccatacttttgcatccttacgaatctcggaacggaaccggatacgcactttattgacctgctttccgttcgtcttcatacgataactgaaccaaccggccgcctcacgccagtgaatcccttcatcatcccccgtacgggaattctccatccggatgaaatggtcgctttccggttgttgttccccacaaatcactttatcggcggtcataccatccaatgcggcacgctccttttcctcttttgccaactgttcctgccttgcctgcaactcctgtacggacagcacaggccaatagaccatataccggcactcatataaacggaaaaacggttccacagtcataccctcatagcgttcgggataaactccggacaatgtaaatgtcaacggcttaccttccacttttttcagatgagaaagaagattgttcttatcccccacaatgacaggcatcgtttgtaaaggcaggcgcggtccggcagcaatgtgtccgccacgactgtcatcggcaaacataccatcctgattttgcttgcccaaccgggcggccagcacaatcggtccatataagatggaatagttggcagaaccatccggcagtgcaatggcacgcaaatgcatcggcagttccagccttactttgtcaccttttgaccaagtacggttcaggctaacatatccctctttgaccgttacgttctgccgtttaccattaacagacaagcgtaatgcttccggcttcgtccattcgggaatacggaaaagaagggtaaattctttctttcccttttccggagaaataacaagagtactcccctcctcatcgggaaaagccgtctgttgctcaatttgggtatctccccagcgcaaggtagacggaatgaaaagattgacatacagattattatccttgtgtccataaatcatttcaccataacgggcatgattttccatccccgatcccacacaacaccagaaactggcctgaggctgcgaatagaccctgtaatgaccggcacgcatcggggtaaaataaacaaatccgccttgcacaggatcttgcgtggaaaggatatggttataaagcgcccgttcgtaataatccataaaatgaacgtccgcactcgtttcatacagcatttttgtaaggcggagcatattgtaggtgttacaagtctcaggcccctgctcgctggtgagcatactgctgaaatcatcagccggatgaaaatgctcacgcacactgttacctccgatggtgatgcttcgatggtttaccactgtttcccagaaatagcgggcggcctcgctccagtcccggttgccttccaaatcggcaatacgtttgaaacctatcactttcggtatttgggtattggcgtgcataccagtcagtttatcctcctgtctcaacaaaggctgcaacacggtgtgatgagaaaattggtgagccagtttcaagtagcgtttgtcgccggtgatagcggccacatcggcaaatgtttcgttcagccctccatgttcgctgcgcagcatatcctgtatctgttcatcgctcaacttggataccagacgaatcatccagtccgtgagtttcaccaacatttcctttgcctcccggctatcggtctgaagagttgcatcacgaaggccggcatatattttatgaatattgtaaagaggaacccagcggtcgttcaatccgaaaccggacgcgcgaatgtttccttcctctatttctttccacattttgcgcccgtttggaactccacacagataaccgtcaccggcggcatcctggcagcgtttcagttcacttatcatataatccagacgcgccttgatctccttatttcccgtagcggcatacatataggaaagggccgataaataatgtccgccaatatgaccgtccagccctgtattttcccaattggtataattttcggctttaggggaaagaccagcttccttcaaataaggagctaacagacggtcggggtctattcccagcagataacggatatccatatcctctgcgtgtttgaaagggctggcggtgagccgcacatccctgactggaaaactttctacttttgcgggtagctgagcatgcaaagctacagaagctatagcaaaaacggaagtggataaaatggttttaagtaaattcatagtattatcactcttatgtatttttatgattcaaagatacaactattcggctgttccggcaaaacaagtttcagccagaacaaccgaatcaataaaaagaatgctatatgtcaataaccgaaaccggttgcttttacatacaccttataatctttaatcatgccgggagctccctgttccgcacgtggcagaatacggaaaccggtcacgttatattctttgccgagatctatcaccacctgatgaggataagccgtattatctaccgtctgccagaaagtactttcttgcaggtcataaatcttgtcggctgtgcggttaccgctacgggtttcctcgctgtcggcataaacaatcttccagttttcacgagagattttctctcctttctcatccaacacatcaaactccgcaatggcggcaatgttggtattatcaaaagaagacagcccttccagacagaagtaacgtcctttcgtaacaggaactttcacttcttgccaaccgttacctggtttgaaagtaccggcagataccggtgtttccttctccagtttgatggtctgcccctgtttacgatgcgtttcaggaacagccacacgaagcatatccaggataggtttgttcaatccgacgatggttgcctctttcgggcctttcaagtcaagaacgatgatttcattcactccttttttcagccagcagcccggcatgaacagggtttgttgaggaccgatttcccagaaacgtcccatggcatgaccgttcacccataccataccttttccccaagactccatgttcaggaacgtatcagccaccttatccaaggtaaaagcagcgcgatagtaggccggaacactttcatcatttttctctatgccacaggcggcagacgagttcatatcctgaaagttccgggaagatacaaattcataatctacgggaagattataaacagtccagcctttcaacgtttcggcattcttaccgttcaccagttccactttctcggtaattcccttgcggtcgtgaatggacttgtcaaagttcacacgccccatggcttccaccaataaatcaagctgtgtaccggcttttaatgcaggcagtgtaagttcctgttctccaccacggcgatccagacgccccaacagtttcccgtcggcaaaaacctgtgtccagtcatgctgttcggtgattttcagaacggttcccgctttcacatcttccggcaaatgggtacggtacaggatacttccccagccttggtcaaatttctccatcggctggatttcctctgtatgcttcggttcgggcagattgtcaaccaacggagctatttgagtgaatttaatggtagggatttccataaccggtaaagcttcaggaacttcaggcaatgtctgtccttcgtccaagtagtccttcaacatatcacgtaaagcaaaatacttgtcggtggtccagcctgcttcgctgataggagcgtcatagtcatagctgctgcacatagccgagtaagccggattattggcaccgccccaccagccaaaggtcgttcctccgtgggtcatgtacaaactgaaagaaatacctttgtccatcatctctttcaggccatccaccatgatttgtccgtcacgggtttcgtgcttgcgcccccagtgatcaaaccatccgctccagaactcgctgcacatcaacggagcgtcgggacgtacttctttcagtttggcaaactgcttgtcgatatcagctcccgtaccaaaatttatagtccaaagcaaatcatccaaaccattattcaggaaattagaactccagtcacattggaacaaaggcacttcagtaaagcctgcggcgcgtaccgtatcacggatggcagacacatagggcttgtccgtgccatacgaaccatattcgttttccacctgcaccatgatgatgttaccaccacgggtaatctgcaaatcctgcaactgcttgcccacttcatgcataaaggctcccacgtgctgcatatagaaaggatcgagagtacgaagctgcacgctgtcgttcttcagcagccaccaaggcagcccacccatttcccattccgcacatacatacggaccgggacgcacaatgacgtacataccatgcttctgagccaatttacagaaagctgcaatatctttattacctgtaaaatcatacttaccgggagtttcctcatgcaaattccaaaagacatacaaacaaagcgtattcatgcccaatgctttacacatttcaatacgatgttcccagtattcacggggaatacgcggataatgcacctctgccgctttgaccacgaacggtttcccattcagcagaaaggtattcttacccgcttcgaatgtcccgggcttattgccggcacatcctgccagcagcaggaccgccagcaacaaagtcagtaatttcttcatcttcatttatctattattatttttcattcttatttatccggattaccgtaaatgaataagccggcaattcatacccgaatttctcgcttacctctattgtaccggatacaggacgaacctgttggtctgtcggttttcctgccaaaaccgtctttacggcagtggtgttcattccttccaaagaggggagctccacttgcgcattcaccgctaccggcagcagattcaccagtttcacgatcatatttcctgtctttccgtcgcgaactaccgacacgcctatccgtttcttcaccgcatcttgtgcattatccaaagtcacggaagaagcgatgtattcactgcccgcattttgtccgtacatctgctgcgcatagtaacctacggtgggttttacctccgtattattgaaataaatcaaatccggattccactgggtatgtccctccttagccagtaacggagcgtaagaagtcatggtcaccacatcggcattacgctccacggaagtcaggtacaaggcctcggccaaagctgtttctatattgttgggacgtcccggcaaatgagccgcatactctcccaaatacactttcgccttgttacggtcataacggtcatagaaatcctgattgttgataaaccatcccggggtgttataataatgttcgtccaccatcggaatacccatcttagtggcgaatttccagccttcctcataatcactgccctcatagaacggacctaccgttccgataacggtcacttcgggatatttctccttcaccgcattgaaaatcatggtgaaacgttcttcaaagatatcggtaatcaaatcctcgttaccaataccgatgtacttcagattgaaaggtttgggatgtccggcttgcgcacgcttctttccccacacggtcttcttcgcatctccattcgcatattctatcaaatccagtacatcctgcacgtactgcggcatttcctccatcgggattccgccttgctgaccgccgcaacccagttcgcctaccgagtgatgactgcaagtacccgaattctgacaaggcactccggctgccactacaggaacaggttcggcccccatatcctcgcagaacaaaaaatattcatgatatcccagaccgcgggtctgatgatacccccacaaattgcgcagaggcttgcgttcctccaacgctcctatagagcctttccaatcataaatattgtccacaccatctccgtgagccacacatccgccggggaaacggacaaaacggggatgaaggtccgccaaagtctgtgccaaatcggcgcgcagcccgttcttcctgcctttaaatgtattctgtgggaaaagagaaaccatatccaaggcatacttcccagccatctgcggacaaacggacaacacggcatccgcagcatccgccgttgccgtcagtacagccttttgttttttccactctgtagatgaaacccgaatagcagcctgcgcaatctccttgccatctttggtagtcagcctcacaagcacttttccacctttcgtatcatccagcactttggaaaacacagagaagtcatacttctcaccttttttcacggcaataccgtcaaaaccgttattcaccaaggcagcacccgggcggtgtacctccaacactgcataatgagcattgttagcatggatgggactgtcctcactgacagacagttccgcatcagtaccctgtatactccacgcatacgtgctgttccagttcttatctcttgcaccgtctttggcagaatattcaaaatcacggttctgaaccagctccgcataaagtccaccatcggctccataattgatatcctcaaagaaaatacctatcagatgctcactaataggcttcacccgtccggcatccacccggatggtggcagtgaccggtttcagtccggcaaagcggacggcatcctgttcggtacgctcattattctgtatatcgcggaatttcttatgctcagcaaaacgaatcaactgttctatatccgcataaggtactttctgcatataaccgttcaaggtatctttatcaaggacaatctgccgggcagtgaccagtcggggcatggcaggcttctccgcattgacatattgttgaggagcccacttcaacaagtcggaagaatgggaagtaccccatacttttccgctgggggtaagctgccaccggcaataccaacgtccatcttccgctttttccagaagaggtttaatcattctcttttccgccccccaacgcccgaaatcacattgcagataggcaaagccgtcggatacactcagccacttgtcgccatcgggactccatgcgaatttcagtccgctgcgtccctcgtcttccggatgggcgtaagagaagatgtagaccgaatcgggctcattatatactttttccacggcagcacagacggattggcctgctgccaatgaggcgattgccagagataataaggtctttttcatggtatatgctttattgtcatgtttcttttataacgtgggaacaaccttcctgatggttccatccggattaaattccatacggtctatacatacttcacgatgcacgccaggacccttctcacgatctataaagttcttattaatacgatgatatacaatgtaccactcatccgtacccggaatttgtaggactgcattgtgcgcaggtccatagatttcctttgcaggatcctgaatcagtaccaccggtttcttagcaacctttataggacctagcggagatttcgacgtaccgtatgccacatgatagttgggcgaaccggtatcatccaccgaccacataaagtagtaaagaccattacgatagaacacatatgccgcttcacggaaagcgtaatctttcagacttcctcctttcggtgtcaatacggtcaaggtattctttttgatggaaaccatatcctcattcagttcggcgcccgccatataaccattgccccagtacagataggattttcccgaaaccggatcggtaaacacatccacatcaatctgctgtccgtggcccacgggagattcagtaataatgggatgtcccaagtctttgaacggaccaatgggtgaatcggctaccgccaccccaatctgcttgccgcctccggctacaggattaccactgaaatagaagaaatatttataatactttccatccaccattttctcttcaatgcacggagcccatgcgtttccatccgcccatgccacctgatcggatttcaaatcaagcatcaccccttcatctttccagtccttcagattatccgaagagaagacactgaaataccatccgccccatccgggctgtccgtcggtggtggaatagatataatattttttagtctgatgagaatacaatatctcggggtcagcatggaaaccttgcagcacgggattgttgggaatcgtcatattgcccatttcctttgaaggccatttgtcggtgatgcgcttcaactcggcacgggtaatggggatgatagttccgtgacgcggatgaaaattcatcttcacctcactgtctatcactttaaagtttttcaaatcggtcgtttcggtaaactggtatttacctttcatatagacatcatacatcaagatgtatttattctgacctatcagtttgaaagttcccgcaccttccaccgcttccggggtctgctgcttgtagtcgggttcttcctcccattgtcccgaagtcagtgaacgggtagttgctacccggatgccgtttccatgtccttcggttttataaaacaggtggtagattccatctttatatacgatatcaccgtctatgcaagatttcttgttttcagggatgaaaagcggtttcggttcaccttccaggtcggtaaattctttattggcataagcataataaatcacatctgccccatcaccatatttcattgaccaataaaccaagtattttccggcttccgcatcgaagatagtctgaggagcccatacccgtttcagtttttcctggccggcataacatttctgcatattgatgacagaatggttccagttcaccaagtctgtagatttcaacaacaccatggcacgattggaatcccatccattgtcagaaaccatatcggtaaccaccatatagaatgtctttccgtcttcgcaacgcaggatatgcggatcgcgcacaccaccggtagaactgatgattttggaatcaatgacaggtttgttgtcattcagtgcccaataggtatatccgtccgtacttaccgcatagcatacggcttcctcgctgatgtggttacctgtaaaataggtaaagagataagctatgtaatctttttcggctacattgttttgtttggaaataatctgctgcgcccctgccatccaaggtagcaaacaggcaaataaggtgataaaaaatttgtttttcatataattagtcctgaatttgtttgatgcaaagatatagtataggaacctattttcaggtatataaatctttcaaaagagggactttattcggtcaaatggaggaaaaatggaagtttatgaaagactggcatagaaaaaaacaaaaagttcttccctattaaactacagtttcagtaaaagaaaaaagcaaaagaatcagctacacaataaattctgattattcattataaatgataactattagcgaaatatattcagttttcatcacaccttttgagaaagatacaaaaataatccttagaaaggacatatttaacatttctatccatatgaatttcattgtttgatttctcaagcaatatgtaccattctacttcctcgctagatacaaaataacaagaataacccacaaaaaactacagcaggttagtcataacctgtaatttattaagaataacaaaaaaaaataaaagaaaagatagcgttatattcttataaaataatacatttgcagcaactgaaatagaaagggaataagatccctaaaccaaactatttactaatttaaccttattaatctatgcaattctaccagaaaagaagggaaaattgtgtaaagacacacgtaattttgaaaaaagcctctttttatgcgtgtcttacactatttgccggaatggctttcccaatgcctttgtgggcttcgcagtcaactgccatcgtgcaacagcatgtcaaacaaattacaggtatcgtaaatgatacaagcggagctcctgtaatcggtgccaatgtagtagaagtgggaagcaccaacggtactattacagatgtggatggcaaattcacattaaatgtatccgtaggggctaaactgaaagtttcgtatatcggttacaacgaccaacaaattaccgtaggcaacagcaacagttacaccattatcttgaaagaagatacagaatctttagatgaagtggtagtagtaggatacggtactcaaaaaaaagtaaacctgacaggttctgtggcaaccatctcatccgataagctagtcaaccgcaccagtgccaatgtcaccaacatgctggcaggacaaatgccaggtgtcaccattatccaaaataccggtcagccgggagctgatgccggagtactgcgtgtgcgtggtctaggaactatgggagatgccagtgccatggttgtggtggatggggtagaatctaccatgagcagcgtggaccccaacgatattgaaaacatctctatattaaaagatgcagccgcctcagccatttatggtgtacgtgctgccaatggcgttatccttatcacaaccaaaaagggaaccaaaggacgtaccattgtatcatacgatggatatgtaggctggcaaagtgcctcacgtatgcccaaatttttggattcttacaattatgcagtgctgatgaatgaagcttacaccaatgacggtttgaaaggtccgtatgacgaaacagccctacaaaagttcaaagacggaagtgatcccgacttttatcccaattccgactggctgggtacgctattaagtgaaaacggcctgttcaacaaccatcacttgagtatcaaaggcggtggagacaaagtaacttactcgctggcattcaactatcatgataaagacggattgatagtcaataccaactacaacaagttcaatgtacgtgccaacattgacgctcagataaacagtcgtctgaaactgactacaaatatggcggtataccgcagtaatatgactgctccggcggcaggtatcagcaacctgatgcactatgctttccgtgagactccggttactcccatccaattgagcaacggcaactatgctttattcaaaaacgagcacaactccgtagcctatgcacgtgaaggaggaacctacaaagagataaacagcaatttccaaggtaacgtaggaatggaactggacatcatagacggactgaaactgagaggagtcgccgcctcgactttcaacctgaccgacaatcccacccacgtaaataccatgacattctatcaggcaggttcagacacaccggtaaagaaaaccactaactccatcacagaatatgacatcaaaagtatggaactgaacttgcaagcttatctggactataataaaaccttcggcaaacacacaataggagccttattaggttactcacaaatttataaacagacacgctatctgcaagcttaccgtaagaacctgcccaactccaactcactggaccagatcaacgccggtgaagtgacaggacagacaacatacggtacagaaatagaatacgccctccgctcagctttcggacgcgtgaattattcatacgatgaccgctatctgctagaagccaacctgcgttatgacggcacttcacgcttccccaagaacaaccgcttcggcgcattcccctctttctccatcggatggagaatatcggaagaagagttcttcaaagccgattgggtggataatttgaaactacgtgcatcatggggattgctaggtaatcaggaaaccgtaaactcggacaacagttctaactattatccgtatcagaacacctatctgttcggttatgactatagtttcggcaacactttgactccgggtatttccatttccaacccgatggctaaccaagatattacgtgggagaaaaccgatcaatggaacgtaggtgtggacgccgcttttttgggcaataaactgacattgggcgcagactggttccgcaaggaaacacgggacatattactgcaacttccagttcccaacatgatgggagtcagcgctccgatgcaaaatgccggcgtagtgcgtaataccggtatcgaactgcaactgggacataacaaccgtatcaatgattggagctattctatcggagccaatttcagctatgtaactaccaaaatcatggatttgaaaggcggtgacacaccggggcaatccgtaggcgacccactgtgggcatattacggctacgtatgcgacggcatcttccaaaacgaagaagagatcaagaatcatcctacacagagcatgggtactccggttccgggtgacttaaaataccgtgacctgaacggagacaaagtagtagacagcaaagaccggcaagtattgggttcttacttcccgaaaatcaacttcggtctgaatctttcagttcaatataaagacttcgacctaagtgcactgctgcaaggtgcagctgatgtaaagagtgctcctgtagccgaaatcagatatgccttctacaatggcggtaaagtaacggaacagcatctggaccgttggactccggaaaacccgaatgccacttatccccgattatccatgagtgactccaaaaaccgcgtgacttccagtttctggatgcaggatgcctcttatgccaagctgagaaacctgcaagtaggttacagcctgcccaaacagctgatatccaaatacggaatcagccgtttgagagtgtattgcagtatcgacaatctctttatgatttccggcttcgacggtgtagaccccgaagccatcagcggcaactattatccattgacccgaaattattccttcggtctgaatgtaacattctaaacactgacaactatgagactaaaatataactttataggattaatattggcatgcggccttggtctgagctcttgcaatgacagttttctggacagaaatcctaaagaccaattatccgatgcatctttctggaaaaacgcagaagatgcccagaaatttgcaaccggaatttatctgtatctgatagaaccggaaaaccatactatcatgacagactgctacacagataatgctattcctgtacatgtcacagccgaacagggacagttgtctgctggtacggcaacttccagcaacccacatttcctacaattatggaaaaatgcctatcaatgcatccgcagatgcctggtattttacgagcatataggcgatgtgccgatggatgaaaaagaaaaagcgcaactgacagccgaagtacagtttctcgaagctttctcatacgctaacatattaaaatatatgggtggcgcctccctgctggatcatccgttggaactgaacgagaaacttccttcacgcagttctgaagaggagacttataatcatatagtaggattattggataaagcagcagccagcttgcccgatatccgcagcaacagtgaccacggaaaaccgagtgccggagcctgctacgcactgaaagccagagttgctttctacgcacacaaatatgatgtggcggaagctgccgcacgcaaagtaatgggcatgaatgtgtatggactgtatgataactatggtgacttgttccaacctgtagcagagttatgtaacgaaatcatctttgatcgcgaatatctggaaaacccgaaaaactctaatgaaggcagttatataggacagttcttcgctcccgtcatgatgggaggatgggaagctttatcacctactcaagacttgatagactcctatccatgcaaagatggcaaatcaatcaaagagtctcctttctataatccggaagacccgtttgccgaccgtgacccccgtctaggcttctctgtactgtggaacgggtcacaaatagcaggaaagactttcaacctgaacaatatgggagatggcagccatacccgtacaggatatagcatgaaaaagtatatcaatccggacaatgacggtatcaataattatgactggaccaactttatctatatccgctatgcagaagtgctgctgaccttcgccgaggctcgtaacgaaaatctgtctgctccggatacggaagtatatgatgcggtcaatcaaatccgtcagcgtcccagcgtaaatcttcctcctctgccttccggcttatccaaagatcaaatgcgcgaagctatccgtttggaacgtcgtttggaatttgctttcgagggaatgcacctgtttgatacccgtagctataaaacaactgaaaaggatgttactaaaccagtatacggggtaaatgcaaaaggagaaagcatttttattgaaacccgcaagttcaacgccaaccgtgactatctgtgggctatccccttggaagaggtagacctggctcagggtgcactgaaacagaatccgggttgggattaacccggtcatttatttggagggacagactcataaagctgtccctccaactctttctacacatctcttttcattgaaggcaaaagtaattacctttcctctcgaaaaaagataaagcactttcaaggaatatatggttttcccaccaccaatttatctctggaaaaatcgacttcaaacaagtgaggaatacgaatataacgcccgtttacatctttatgactatgtacagacatcaaccatttaccgtccaaggtctgaaacaacatcccatgaccgaaattgggaggagtaatcgggtctttctcctgtatccatggtccatccaaggttccgctttcagaataagccactccctgagtgtacacattataaatccaactagtccaaatcataccgagtctacctgttcctgtacggaacagatacggaccgtcagtgactttattcggtttgtccttgccatccgcatctttttcacggctccacggcgattcgctggcacggaacagcaatttcccttcgcctatggttccacttaagtcaggcttcagttctattttctctatcgtaccgtccaaggcttgcaaccattcataacaatataccatataaggctttccgtccttatccacccagaaagtcccatccaaggttggtttatcagcaggcaggtaagtggaatccttcatcggaacgtaaggtccgtccgggttatcgctcaccaaaacatgactggcacggcgctctattacattcccttgtaccgtatcaatcttcaccgcctgattggtgaaagtggcaaaataataatacttgcccttatacggatgtaactcggcagcccaaatcattggtttcggtcccatccacgaaccggaatcagtctttgccacatgaaacggtccttcccaaagtttcaaatccttgcttttccaaagcataccgccggttccggtcatataatacatagccgtcttcctgtctgccaaaatgcaagggtcactcagtacaatagaatccaaaggcacttccttccgtctttcctgctgacgttcttggcaagcagacaccagccacgaaagagaaaaacctaacaacaaaaacaatccaatctttttcatgcatattctattttaagtttcacaaattcgacattacaaatatacgaacctagaaaggtaatgaaaacagaaaggcacatttcctcacgaaatatgccttcaattctaacttaacctaacctaaaattctattatcacatcacagtatgttaaccttcttcctaaaaacctatctttaatacctattatctctttttaccgatagcaaagataaaaaatctgattgacaaccataggggtaaaatcgagcaagatggatgcaataatcagtcaagaacagactattgcactattttccatccttcagactattttcaacagggattactgaaagaaatccagtgtccagttgtccatccactccacgtatggaattccttccttgaattgaacaggtaaccaaatgtaacgggcatcactgggatgctccggacgccagatatccgccataaatataaaggcgtctttcttcccccccactttcagaatataagtgctctgtccgccaaacgtaagttccgacttaggtcccacacaagggttgggatgctgagaccacggtccgaagatggaagaagacgagaacatacgagcctcattgggagcccaaccggtacaaccggaagtgatcatccagtaggttccgtcttttttgaagatagcaggtgcctcattgtgtcctgccggagccacacgcacataattccctgtgtgtgaaagatagtcatcgctcaattccgctatttggagtgtgaggttttcttcggaagagtaaatatggtaggctttaccatcctcatctacataaagagtcatatcgcgagacatctgtccgccatccaaatcacgctttactatcaagcctttgttcacagcatccgtccattcgggagtccaccatttttcataattcttggcattcagagtatccagcactgcaacagcctgtccgtccatatcaacaggcagcttaccagcattgacacgtcccgaacggatgaaacggtaaggaccggcaggagtatcactgactgctaccccggcacgggcggctgcataaccttttcctttcaattccagatggaaccacatcacaaacttccctgttttcgcattatatatcactttaggacgttccaatatacatccacgcgctatgtcgctgctgtcgttatcaacaacagaaagcgctacgccttcgttcttccagtcagtaagattccgagaagaatagcacattactcccaccatggcactgctggtagtatcacatttattctcaccgaaccaatagtatgttccatcatggtacattactccgcccccatgggcattgatatgctctccgttgttatcaggccatatctcacctgaacgaatgggttgcaacggttcattgctgcatccgcaaaaggtatatattccaagacataatcctattattattttttttatacccatatctatgtattttattttttctgataaacacgtacataatcaatctcataacgtatcggataggtatttatctctacctcgccaccattaattccacccaccgctaagttcaacaatatatattggggttgcataaatggattcttataactaccaatactaccattataggtatctttcagtaagatttcatttagcaactcatcgtccaaataaagacgaatagcctcttcgtcccaatccatccgccatatatgaaattcggaagcccaatccgaatttttctccaaaaaatggataaatggaatagccttactattccattttgcattccattgacgatctgttccccatgcagcattggctaaaatatgaggaattccatgcttacgataaaactccatgatatctatttctccacaggaaggccattccatactgcttcccaaagtccaaattgccggccatgctccttttcctacaggaatacgtgcgcgcacttcaaaacgtccatacaaaaattctttctttccaaatgttgttatagaagaagaggtgcactcaatatattcacgagaagtgcgccaatcataactacctgctttatataacggatttttccgtttttccgaacgtgcttctatcacaagcaacccaccctgacaccaagcgttgtcagattgataccattgtaactcctcattacgagcataaccctgttcataattccatattgattcatccaaacaaccgtctttattgaattcatcactccaaaccaattgatagtcttgtgcattacaatgcccccctataagaagtacaacacacaatttcagtaattgaaataattttatcatacatctactatcttaaacaatatctttataatcatcacaagtaaatattccaatggtgatagcggctgttatacagccagctatccattgtccttatttttcaaattcctcttctgtttttatttattaatccaaaggcgcagtttccggatcatctattgcaacttctgcatcatacatcataaattcaccaatattccaataggaggaacttccagtagcagatgttacactaaaacgaaaataagtaaaagtcttacctggcataaagaaagtagaaatatattcacttccggctgaactagggagtccgtccaatgtacctacagtttcccaatcaataccattattactaatttgtaaatctaccacactaggacgtccacttgtggtccaagaattatccgttctgtttatgtaacccacgagaaaattttcatgaggttctttcaaattaacctgaatccactgtggataaggaatagcttcatgccaattcgtatgaaaaaaagtatttttatccccatccactgcattttttataggtccttccgacggttcttgagcgtttgtacttaactgttctgccactaatttgatttgacttcgtgacactaaagtataagacgcaggtgcaactcctgaaagtgctcttacaactttaatctcgccaccttcatcatttgcgttaaatgtttggaaattaaactcatattcaccaaaacgagcacgagtttcatctatcaacaattccgtagttccttttgaaacaatcttatagacagtttcttttgtcaaaggatcataataccatattttaagataggaaaagtcaccagccggaacttcccatctaagttgaatttgaccgggaagagactctgaagttaccgtctctatagcaaccggaacacctgtatatcctattacatcaatagcatctaatttatcatcgcagcctgcagtaaacataaaaactgacaaagctgctatcgtatattttatattgaatttcatagttccattctttattattcaacaatatttactattaccaacctggattctgaattagatttggattttttcttatttctgaatcagggataggaaacaaatacatcttatcatcccaataacgattactaattacacgtttataagtatatgtatcattatttttggtaatttgcatttgtacaatacttctttgagtatctccagccttccaacgccgaacatcccaaaaacgatgttgttcaaaagcaagctccaccatacgttcacgacgatatttctctacaaactggttattagtcaatccttcaggtacttcaggcatttgcacatctgaacggttacgaaccacattaacagcttcacgggcagacattgtgaattccgtactaacagcatcagctgatcccaaataattaaataccgcttcagcataatttaaatagaattctcccaaacgatatgtaatccaattatggcgttttcctccactactggtagaagcactaatatcaatagtcttatccaagtactttttcaaataatacccggtgggagttgctccagcaataggtagtgcattgcgtcctcctatataaatttccaatggatttggattagtatctggccatttctcaccatttacagcgatagtcatttccatacgaggatcacgattatcatacggtttatttggatcatatccactttctggctcatcccatgcttttcctgttactttcatttcgtaagcatcaaccaaagtttgagtaggacaattacctgacccaccattttccattcctactgggaaattagtatattcaggcgaactagtatctccgatacgacgtacaaaaatcatttctgacgctttccaattatctgttccccataactctgaatatttacccatttttatgccattctctgcacaaaaatcaataactttcttactagctaaagctgcttgtttccacaaatttacatcattagctatattaaataaagggcttgcttgataaagtaatgttcgagccttcaaagccaatactgcctgtttagtaatacgaccagtttcagggctttctccattagcggcatcattttctaatttagaataatccacaggaagttcatctgctatctcatcacattccttaattataaaatcaaaaacctcagcagccggtgtacgcttcacctgattggcctcttcttcagtcagcaccttcgtaaccaaaggtatatcgccataagcacgtaccaaattaaaatagaaataagcacgcaaaaaacgaacttcatacttataacggttaaagcgattcatctcagctacataatttttatcttctttcaattcagaaaaatcggcattttgtgattcctccaaaaagaaattagcatccctaattccactataataattccatagactatgagaattagtcgagctccatgcaccgtttatccaatcatgtattgaagaccaactccacgcaaattgcgcctcatcacaagcagagcaataagaaacctcactaggcaaatcataatccaagtaactatatatattcgtaactacagctccggtacgtccaaaatctgtaaatacataatctttatcatacacagtatattcatgatagtccaaatccgcacaagaagccataaccgacatataggctaaccctaacaatatttttttcaatttcatagtcatacttttttagttataaaaaattaaaagccaacagacaaaccaatattaatagaacgtgtggtcggaataccatttcctattgattccggatctatttctttaatatggtcccaacagaacaaatcaacccctcttacatatagcttagcactgttcaaatgccatttattgacaactgaatgaggtaatttataatatacttcacaattacgtaattttaagaatgatccatcaaccaaccatacggaacttgactgtgtattattctgaacagtttcagtagtcaaacgaggatatcgtgcattaggagtttctggtgtccaacgattttcataatagtaatttgaaatagcattgccattagacaatggacgatacaaaccattcaatgtagtccatgaagtataatttccaaccccttgaaaatcaaaattaacccctattcctttccattctgcgcctatattgaatgaataataaatttcagggacactagaattataacctaaaggaatctgatcaaattcattaattacattatcgttattctggtctttatacttaatgtcacctggtttcacgacaccgaactgttgggacggactatcatcaatatcactttgatctacaaaaaatcccactgcttgataaccaaaaatctgtcccacggcttttccagtagcacgaagatactcataagctttcggttcttccaactgctctacaattttattcttagttaaagtaaatgttcccccaaaattgaaacgaaccttacctaagctttttatataatttgctccaaattccaaacctttactatcaaccacaccagcattagcataagaagctgttgcacccaatattgacgaattcttaccacctgtatatacccaaatatcttgacgcttttcataaaaagcgtcagctgtcaacgttagaccaccaaataaagtagcatccagaccgacattatatttatacgctttttctgttgtaccatttattgagggcaattgaccttcctgccaacttccaccattactaaaattatcttggataggatatccaccaccactcccgttcatggtttcataccaatatccgttataaggaatattatccgtattaataacgccgaatgaagcacgtaacttcaagaaattcagccatgaataattattcaatagactttcattagatgcaacccaagcaagtcctactgtaggagaaatatgccattgatttcctgtttccaataaattagacgctgagtttactaatgcaaaatcgaagaaataacgatttttatacccataatgcgtataccatgaccaattgcaatgataaagattagagtttatattggcattattgtcatatttataagtatacatcaatgttgtatatactttatgttctccaaactgacgcttccagtccacatttgccataaaattgaaagaacgatactgccaatcaagtttacttcctcctttcatctcactgtccgagccacctgtatattcggaaaaagcactcggttcaccatttttccattctgtcacaacagtacttccatacgcataatctttgcaatgatcctcccaataagaagcaacattatcatatcccatacgaaaagaggctcctaaacctttcgtgatagaagacaaatcctgtcttaagctcatatctgcccacaaccccaatgtatgtcccttggaataaccgcgaccctgagccaatgcaactggattattatatccatcccatgttgcattaccaccccacaaaccattttctgtacgaataggaaatgccgcagatggagtcatatataattttccaatcaaattatcagaaccatatcccggacgactaaattcatttaacatccccataatatttacctgcattttagtcttaggagtcaaatcaatatccaaattactacgaaaatttgctttagaatacttctcttgagttgaataaccatcattctcattggcatttttataaaagccacgaccgttttgcaaattcaacattgtataataacgcaatttagaagcgcctccacgaaaagttaaagttgcaatatctgatgatcctctttcacggaacacctcatcccaccaattgacattgggataataataaggatatttgccacttttgaaagcattcaattcattctgactatatttagcagcttttccatcattagccaatgcctcattcatggctctagcataagtatacgaatccgacatttcgggtaaacgattttgataagtaaaaccatgatcataagcaaaacttatttcacgcttcttatataatccacgcttcgttacgatattcactactccattcgctcctttataaccataaagagccactgcagctgcatcacgcaaaaccgttacggactccacctcttccggtgtaagataacgtaaaacttgataagcgttatcacgctccaaaccatcaactaccagcaatataccattattaccatttaaacttttttgcccacgaatgaacatagaaggtatttgctcccacatggttcccgttttttgcatagtagtcaatccgagcacattgccgtacaatgaattacctacggtatatgaagatctagttgcaatatcatcactataaacagtagaagctgctcccgtcgactcagtataggtctgttccaatccaaaaccgtaattcactttattcgaaaagaaatccattataacagtcatctttttatccatttccgcctttactactttttttgcatcatacggcgtctgaatccaaagctgagcatcctttgatactgaaattgtaaaatttcccataacgtctgtcgataccatagtaagtggttgccccaatacagacacggcagctcccgataccgggtttcccaccttatcaaccaccttaccagtcacattaacttcttcctgtgccatggcattcatacttgtaaaagcaagtattgtcaaagctaatattttatttttcattgtttctagtttttattagataaaaaatcaagtattaccaacctggattttgagtcaatccatatcctttgtttacttcatttacaggaaatgcagacaaataccattttgaattgaaatttgtccaccatgcacgagctgaattagatattttgaactgagtatatttaaattttgtcggaaaaggtccccgtttatcttccggtttatcagaccatgaaccacttccaccatcagcacgttcaataagcaaaccatgtaaaggacgctcaaaaagatcagcacgcttattacgtatcatatcaaagaaacgaacatcttccaacccaagttcacaagcacgttctcgtaatatttcttccatcaaagcattcgaatcagatagtaaattcttgtcttgattcgactctatcaacccttttaatccgacacgcgcacgtaccttatccaccatctctatagctagtttcggttgattatttttcagaagtgcttccgcataaatcaaatacatttccgacatacgtaaataaggccattccaaataattattggctagacttcctttaccttctttatagaatttatataaaccgaagcctgttgcatactgtcctgtttcagtacttgtactattagcgttttcacgtcctcctacccataattccacagaacggccactccatttagcaccatttaccaaaattgtttcatacaaacgtggatcacgagtaggtttattataatcattattctcaaaaaacatattattattctgtactgccttatcaaagtcaaaggattcgcctgttgccatagggaacatttccatatactccaatgtaggcgtataaccgccattgggcacccaatcgccccaataataccaccaatcccaattatacttaccaatgatacgggtagaaatcaacaattccgaattttcacgtaagaaataagctttattaaaagccgctctataggcatcattcgtatcaccaacagcctgaactagttcataatgcccattaacttgcagggcttggaaaaattcttcacaagcagtcagacatgctttccataattcaggtttatatcctccgtaccacacttgatgattgataaccgcttcttgtggttctgccgtacaatatggttcattgtcattaaataaaggacttgcagcaaaaagcaaaattttacatttcaagcccatagctgccgctttagtcatacgtccttgccagttagcctctccatcctcagtcaaatcccaaggaagtacagtggccgcttcatctaaaagacctatcataaagttcactgtttcttctacggtagctcgaggaacatcatattcattttcagccgcaaaagacgcttttactataggcaatccaccaaaatgacgaaacatatcaaaatagcgagaagctattattaccttcgcttccgctttcaatcgttctttttcattcccgtccatatcgggtacacgatctacattttcaataaagatccatgaactacgtattgcctgccaagtttcttctttagtaaaaccaaaacgtgtttcagctgtaccatcttctgtactagcagtataagtaccagaataataatgtctattcaaaccatcccatgaattatgagaatgaaaacaatcagataaacattcaaacataccagtattcatcttaccatccacatcattccagtttgtggccaaaccataatacaactttgaataagtattccacaaaaaacgacgagcatactccgctttaccgaaaattgtatcttgagttacagccacacttggtgctttttccaagaaagcatcaccgaattttatatcatcgacacatgaagtggcaagcgttgctcccacaaatgctataataaaccatttttcaaaatgtttcataagatttcaagatattagaatccaacttttaaacctaaattaatcacgcgagtcaatggataatttggacgatcactttgacgtgactcaggatccccccacataaaatccgtcaatgtgaataagttatacgcacttacatataaacggcactgattcatttttattttcttcatgaaaggcatattaaaattataccccaattcaacacttttcaaacgtaaataacttgcatcacacaaatacaagtcggaagctctataattgttcgcttgagctaacttcgatatacgagggaatttagccgtataagtatcggccgacgaacgccatgtattttcatattgataaagaagcaatcctttattttgtgtatctcccagcggttgacggaattcggaaagcatacggtctacattccacgctcctgtaaactgcgctgtaaaatcccatcccttccaactaaatccaagattcaaaccagctgtatattcaggagtatccacataccccaaatcacggctagcatcatctccatcaataacaccgtcactgtttaagtcagcaaataccgcatcacctggctgtaaagataaaccatgatctgctataggtctaccaaattcttcctgatatctagcctctgcagtttcatcataatatccccaaaatttataaatcaaacgagaaccaattgtacggccagtttcatacaaccaatcttcattcttttcaatctcattcttataaacaattttgttgcgcgcaaaagagagattgaagtttgcccaataacggaaatcatcaccgattttatcattccattttagctgaaactcatatcctttattttcagttttaccaacattcataataggtaaaaccatacccaaaattcccggcatataatctggagaagaaagaatatctcgacggttttctttaaaataatctaaagaaatatttagtttttcattcagaatagaaaaatcaataccataattctgcttaacagatttttcccaagttacatcagcattcgatttactagcctcataagcacccggcttcttatttccagcattcgtaccgaaaaaatagccatcgtcattcaaaatataagcgtctggaagatacaaaaatctattatttccgttattatcattacctaccatacctacagaggcacgtactttaaagtaattgatcactttctttaacggcttaaaaaaagactcttcactgacaatccaaccaatagagccagctgggaacaagccataacgtttacctggagcaaaattctcagaaccattataaccaacattaaactctgccatatatcgagttttataatcataggtagcacgccccacaaagccaacataagccgaaggaatatcatcataagtacctcctggataatatcgttttgattgattataaagcaccaaacctgtcacattatgatctccaaatttgcgactgtaattcaaagcagcttccatataccaatcacgtgatttaccttcaccatttgaattacgactataagacaactgagaatcagagccactcttacgataaccaatagatccatcatcatgaagaactggtgtatatacagccatagaagaactggctattttttgtgtccaataactagtattataagaacccttcaatttaaaagaaagtcctttggttataaaatctaacttttgatccaatacaagatccacattcaacacatttgttgttgtagaacggaagcctttcccataataagaattcaatccgtcagatccagtaaatggtagataatcagcatttgaaaccacacgttttccatctacaatgcctgcaccagcaaaaggcacagcccaatataatttacggaacagctgattctggtcttctccagactcaggagtacgtttagtttcaatacgcccaccaatattaacagaaattaatgtagtcttagtcgcatcaaaatccaaattagcacgataattgtaacgtttgtagttaaagttaaaattatcagacgctgcaagttgtttgaacataccatcttgtgtaaacatacctgctgatacaaagtaacgcattctatcagtacctcccgatatatttacattatgttgtgactgaaacgctgccttattcatacagtaatcaatccaattaatatccggatataaaataggatctgtatgatctctgaattttatcaattgctcttctgtaaatgtaggtactccaccatcatttacctgtaaatcattataataagacgcatactgataagaattggcaaattccaattgtttcgttcttaagttaacacctgccgaagttgaaaaagaaattttagccttaccttcagcaccacgtttagtagtaatcaatataacaccattagcaccacgaacaccaaatacggctgtagccgaagcatctttcaataccgtaatactttctacctcattggggtcaatctgcgaaaattcgcgttctaccccatccacttgaatcaaaggtttggcattattccaagtagcaataccacgcacatacaaatccgcctcatcagcaccgggttcaccagaatattgcaccgaagaaatacctgtaatctgaccagacaatacattcgacatagacgcagcaggagtttttagcaaatcctcacctttcattgaagaaatggctcctgttatagaaactttcttttgtgcaccatacgctacgacttgtacctcacctaacatttgtgaatcatcttcgagcacaactcttaaattcttaccagattgaggtgtcaagacttgatctttgtaaccgataaaggaaatttttatttttccatttttaggtactgaaatagaaaaagtaccttcaaagtcagtaattgttcccattgtagtaccttctacaacaacattcgcaccaatcacaggctcacccgaagcatcaacaacaataccttttatagtttgctgttgatgtattaattgaacagccataaccttatcggcagctgacacaaccaaggggtgagaagctatgaaaccagtgcaaaacaataagacagtagtaaatgccttacgatttctcataaatgagttagatttcattgttttttccttttttaaaattagataataaggtttataaactctttatattttgtggcaatctttttaccccaaaaaaaactaatcaacttattgtttcatctaaagttttttactagatttacaaatgtttttagataagatatcctttaaaacgatgcaaaaataaaagatgttatgaaaaaacaaagattaaaaattaagcaagaatggtagaaaaatcattcataacgagtttttagtccataattgtcaaatattctatggttcataaatttaatataatcaattgtattagaattacatatgttatatatatgttattagatgttttaattccagctactgcccagccatatatgattaaaagattgggagtagaagacggaatatctagtaattatgtagttggaatcacccaggatcaacaaggttgtatgtggatcgcaaccgaagacggattaaataaatttgatggtaatcatttcaccgtatatacaaaacacacctctggcctgaccagtaatgaactaaataccgtattggccgatcccaatgaaaatattatctggattgcaactcaacgcaacggattatgtgcatttaactgtgatcaagaaacatttacctcctatatagctgaaaagtcacaattacaaacaaatgacattactgacttgtcttatgcctcagatggaggaatatggataacccactatcatgtcggcatagaacattataacccccgaaccaaaaaattcacagcctatagaaatgatgaaatacaagggttaccgattcccaactggacttcttgtgaagacagaacagggcatttatatattggacatgccttcaatggattaagcatcttatcattaaaagacaagactgttaaaaattatatacctgatcccaaggatcccaacagtctgcccggacaagaagttcgagccatttgcatagacaagaatgacaatgtatggatcggaacaaacgcaggacttgccctctttaatcctaccactgaaaaatttacagtattcaaacataatcccaatgatgacaattcactattatccaattctatatacgatatcaaacagatgaaagacgggaagatatggatatgtaccaacatgggaggagtaagtatattagatttacaacataacgcctttatttctgcagaggaaatagattttcaaaatataaaggccaccaatgacaattatgggctatcttcacctaatgcacgatgtgcctatcaagattgttatggtaatatatggataggaaactatcggggaggtatcgatttcattagtcatacccaacccatgttcaatattctaccttatacaatagaaacagcaaaaggactaagctacaaacaagtgtggggaatgtgggctacagacaatcaagtatggctaggaagtgaagatgaattgggattatttataaatggaaagaaaataaagacatatgatctttactcgcatgaacttgtgtacaacacgcatatcaataccatttatgaagacagacagaaacgtctatggcttggaacttacaaaaacggaatactgctctataaaccagataaacaagaaattgttcacatatcctctagtctattcaacaatctagatgtcagatgcttttatgaagatcagaacggaaaaatgtggattgggactgaaaccggaatctattcctgtacaaatgaagtactcgtaaaggaagaagaaatacaaaaacaattaccagacatcatggtacattctcttttgcgtgacaaagaggggaaattatgggtaggtactttcggcaaaggcatctctatctttgatgtaaacaataagctactatggaatttcgttattgaaaacggcttctgctccaatgctgtgaatcacatgataaaagattcagaagagcaaatatgggttgcgacccgcgaaggactagccgtattcaaaaataccagccaaccaaacagatacaaaatctttaaagaaaaggaaggtttagaaaacagtcatatacgtgctatttgcgaagatttggaaaaaagaatttggataagtagtaatgacggcatctcctgtttagatccaaaacaaaacctattttataattataatcatcacgacggagttccgatgggtgatttcatgaacggctccacttgtatgactcacaatggaattatctatttcggctctcaaaatggagcatgtttctttaaccccaaagaactatcttctatccgccaagtttcccctgttaaaatcacccaattctgcaaatacaataaaaaaacagaaagtaaagatgctgaaatttcaattccattcaaaaagggagtagtccatttaccttataatcagaatagttttcgcattacatttaatgtattagactacacacaaagtccacaggtagaattcacttatatgctagaaggtcttgaaaacagatggtatgacacacaaggagaaaatcaagtaatttttcgtaatatacctccaggtaaatataacttcaaagtgagaacacgcatccgtaatcaagaatgggacaaagaaatcgcctcattgaatatctttattgctcctcccctttggcttacctggtatgccaaattgggttatgtcatattgtttatcttcgcattatatgcattgctccgtttttataaacgtaaactggacttagagagttcactggaagtggagcgcaagcaaagtctgaacaaacaagaactgaatgaagaacgcctgcgcttctacaccaacatcacccatgaactgcgtactccgctcacgctgattctaggtccattggaagacctgttgagtgatgctaccttatctcccaaacacgccaacaaaatcagcatcattcatgatagcgccacccgtctgctgaatctgataaaccgcatactggaattccgcaagaccgagacccagaaccgtaaattatctgtagccaagggagatctgggacaattggtacaggaagtgggattacgttacaaagagttgaatcccaataacaaagtaaattatcatattcatatcgaaacagaagatacggaaatcttctatgacgcggacatgatcaccatcatactggacaacctgatgagcaatgccgccaaatatacttccgagggagatatcaccttatcactccgttcagtagaagagaaccagataaaatacacggaaatcagtgtcagtgataccggtcatggcattgacgccgaagcgttaccacacattttcgaccgctattatcaggcaaaaagcaaatatcaggcatcgggttcgggaatcgggctcgctctggtcaaaggtttgagcgaattgcacgaaggaatcctgaaagtagaaagcacagtagatacgggaaccacattcacactgcgtctgctcaccgagaatacgtatcccaacgctatccatgcccaacatgatatggaaaagaagccgatggatgcagaggaaaccaccattaccgatacaccaaccgagaatcatcccattgtactggtggtagaagacaatacagacatacgggaatatatccggagttcttttactgaactctatgaagtaatcactgccaaggatggtaaagaaggctgggaactggcacaggcacgaattcccaacatcattgtcagtgatatcatgatgccggtcatggacggtatcgaactttgcaagcgaataaaagaggatatgcgcaccagccatatccctgtaatcttactgacggctaaagattctttacaagacaaggaagaaggatatgcatccggagcagattcctatcttaccaaaccgttcagtgccaagctgttgcacagtcgcatcaacaatctgttggaaacccgtaagaaaatagcctctttgctggcactggccgatatacagcccaaacaggaaagtgccgtgagttcgttaaacaaactggataatgaattcttgcagaaaatcacgcaaataatcgaagagaatctggaaatggaaaagatggatatcgctttcattgccgacaagatgtgcatgagtcactctaccctttaccgcaagataaaaggactgacagatatgtccgccaacgaatttatccgtaaggtaaaaatgcgcaagggagtggaactgctgatgtccggacaatatactatttcagaaatagcctatatgataggattcagcagtgtggcctatttccgccaatgtttcaaggacgaatacggaatgtcgccttcggattatgtgaaacagaaacagtagactccctggcggattctgatcattgcttggtatcatcctgagcagttcttctttagagttttatatttctgctaccacccttcctgctgaaatgccgatgaaaagtggtagcagtggagcaacaatataaagctcgtttgttgtagaactcttggatcaagttataactgtcacaatcgaattcaagtccagcctgaacattctgtttctatttttcttccaaagaaagcagtatcccgatcacttccgcataattctttctaccggaaggaatgttgttaccctttaaaaacaggttataaattttattctgcacttcacccaacagggtactataacgctcatgccaatacatacgtttatattcataatccttcaccacttcgggacggatcgtcttaatccattcacggaattcctcttccgtcaacacagaagatgcattgaccagcacatagggcaacagaccgaaataggcactataacgcaccgccggccgctttgaagagcgacaaaccctgtaagcccaataattcgcttccgcctcattacttacccccaacaggtgagacagttcatgggcatacgtaaatggcaattgtacaggaagcaattcttcattcaattgcgactccgcaaaaaaaggtcccatatatcccaatacccccacacccgaataaaacggattgaaccacacctgcttgggatgctgataatcccggggaagagccaaaccatacatagacggaacctgccggtaaatctcctttatctcctgccgcatcctttcagggtccgttttcacctcagccgtataggactgattcagactatctgtataggaagcaaggaaacgatggaaagcctgttcatcgtaaccggcaggctccacctccatccgccggtaaatatcgtaacggaaataattcaagccccatcccagataaaaccagatatagacccatgccagcaactccacttccctgcccacaataaatctccagcttttcttcttccggcgtttaagaaaaggataaataatcatccataaaatgattacgaccaccagcgcctcctccaaggaaaaagggaaaacagaagctatagcggacaacgccgccgacagccacggatagatatgacgggcatacccttcggccatgacgggaaaaaaacggcaaagtacaatgcacagaagaagcaatgcaagtactatatatctcagaatagggagaagttttgttttcatggatgcaaagttactacaaaaaagtgaaatgcggaaagatatagtgatagaattgagttacaagggttttggttgaagtggcgataatccgtgaagccattacaatccctgccgaagccaaatcctgacgccgctacgttacttgttcgtaaccatgcccgaaaatgcgacaaacgggtacgaatagcgaaacaaggctctaaggaatagtgagttatccataactcatgcgaaaaatcaggttacggaaaaagattgcgccgttcctccccgttttgcgtaccaacaccggactcttcaccaactaattttgaaacccaaaaattaaggacaatgaagagtacattttcagtaatctactacctcaagcgtcaggtagtgaaaaaggacgggacagttcccgtcatgggacgcatcacggtggacggcagccagacacagttcagctgcaaactgactgtcgatccgaaactgtgggacaccaaaggtggacgtgtcacgggcagaagcacggcggcactcgaaacgaaccgtatgcttgacaagatgcgggtacgcatcaacaggcattatcaggaaatcatggagcgtgacaacttcgtcacggcggagaaggtgaagaacgcctttctcggactggaacaccgctaccacacgctgatgcaggtgttccgccagcacaacgaggactacgagaagcaggtggaggcaggcatgaaagccaaaggcacgctgctgaagtaccgcaccgtttacaagcacatgcaagagttcctcgacatccgctaccatgtgaaggacatcgccctaaaagagcttaccccggctttcatctccgacttcgagatgttcctgcgcacggacaagcactgctgcaccaataccgtgtggctgtacgtctgcccgttacggacgatggtattcatcgccatcaacaacgagtggctgacgcgcgacccgttccgcgagtatgaaatcaagaaggaggaaacaacacgcagtttcctgaccaaagatgagatccgcctgctgatggaggggaaactgaaaaacgccaaacaggaattgtaccgcgacctctacctgttctgcgccttcacggggctgtcgttcgcggatatgcgcaaccttacggaagagaatatccgcacctacttcgacgaacacgagtggataaacatcaaccgccagaaaacgggcgtggtgtccaacatccgcctgctcgacatcgccaaccgcataatcggcaaataccggggactgtgcggggacggcaggatatttcccgttccgcattataacacgtgccttgccggtatccgtgccgtcgccaagcgttgcggcatcaccaagcatatcacgtggcatcagagccgccacacggcagccacgacgatattcctctccaacggtgttcccatcgaaacggtcagctccatgctcggacacaagagcataaagacgacgcagatttacgcaaagataaccaaagagaagctcaatcaggacatggagaaccttgccgcaagattgaacggcgtcgaggaatttgcaggttgcaccatctaaaaagaaaagccatgaaacgtgacacaatcatcatcgaggacaaggcagtcagcgtaaccggtaacgacgtgtggatgaccgccaccgaaatagccggattgttccatacgaccgtcccggcagtgaacgccgccatcagagccgtccgcaagtcggacgtgctgaacgactacgaggtgtgccgctacatgcagcttgaaaacgggctgcacgcggacgtgtacgcccttgaaatcatcatcccggtcgctttcagggtgaatacctacaacacccacctgttccgcacatggctggtgggaaaggcactctcacaagagaaacggcagacatacgtgatgttcatacagaacggaaaagccgggtattgctgattgcacataccccataagacaagtaaacgggtagcaccacaaaaggtgtcacccgtttactttttcatgaaaccgcctcactccagcggcttgcggtagttcgcttccagtaccccgcgcagccccgtttccgggtaaagcaccttccctcccaaaagtatgaagggcaacacgcggttgttgcggtattcctgcaaggtgcgccggctcacacggagcagttccgacacctcgccgtccgtcaggtaacgttccccgtccagcggaggacggtagctttccagaaatgcggacagccatttcgagcctttgcgcatatcctgcaccacagaggctatcggctcgtcttccatcgtaaaaacatcgttgttctcgttcatcataacttcggattcagtgggtgaataaatcaaatcatctgccgtgcggatagagcgtgccgacaagcggtatcagccgcttcacctcctctggcttgtaatagaacctgcggtttatctgcgagtagccgataagccgcctgtcacgcagcgtctgcaacgtgcgcgggcttattctcaactgcccgcagacctcctcgcccgtgagccatctttccatgcgccccgtgtcgcttttgcgcctcagggcggcgaccttctccgagagtgcgccgaatgccgccaccatcatctcgaaagtctttttctcgatagatactatttccatattcatgtcatttagagtttgccgcaaaggtaacgaaacggcatacaagacgtatcgttttccgctgaaaggctgcctgttgcgccgtttgaccgggttacggagccatcttccgcaaaaatcttacgtgagtcacgtagtgagttgttaaagccccttttgtttattgccgaattttgtcgcagaaacaaaaagaaaggactgaacatgaaagtgataacaatggaaagttccgcctacaaggagatgatggcgcagattgcgaacatcgcagggtacatccgcgaggcaagggacgagaagaaacggaagcgggaaaccgaagacaagctgcttgacacggcacaggcggcgaagatgctcaacgtgagcaagcgcaccatgcagcgtatgcgcaccgaccaccgtatcgagtatgtggtggtacgcggaagctgccgctaccgcctttccgagatactgcggctattggaggacaacacagtaaggaacgaggaagggacaatagacaccctgttccacaaccacacgctgcgcacgggcggcaaaccaaaaggaaggaggacataggtcatggaactgctcacacgaaacaacttcgagggctggatgcagaagctgatggaacggctcgaccgtcaggacgaactgctgctggcgatgaaggctgaggggaaacagcccactatcacggaaagcatccgccttttcgacaatcaggatttgtgcatgttgctccagataagcaaacgcaccctccaacgctaccgcagcgtaggcgcattgccctacaagacgctgggcaagaagacctattacagcgaggaggacgtgctgacattcctttccaaccatatcaaggacttcaaaaaggaagatatagccttctacaaggctcgtatccataatttctttcataaataacccattaaaacatttttcagatggcaaagaaaaaagacgaaaaggacgtgctggtagtccgtgacgagaagacaggcgagatcagcgtggtagccgggctgaacgcggacggcacacccaagcgcacccccgcaaaagcggagaacgcgcagagtttcctgcaattcgaccgacatggcgacgtgctggacaacttcttcaagaacttcttccggcagtgcaaggaacccagccgcttcggtttctaccgcattgcggcagaccaagctgaaaatctcttagaggtgatgaagcaactgctgaaagaccccgaagcgaacaaggagctgctcgcccctcacaaggtggacacctccgactatgagaagaaggtgcaggaagagatggcagcacaacagacagagaaacaagaacctcaaaaacaggagaacatggaacaacggaaagaacagcaacaggacaaatccgaacagatgcagggcaaacgtggctaccagcccatcgacgagagtaaaatcaactggcaggagctggaggacagatggggcgtaaagcgggacaaccttgaaaagtccggcgaccttacgaagatgctcaactatggcaagtccgacttggtaaaggtcaaaccgaccttcggcggcgaatcattcgagctggacgcccgcctctccttcaagaaggacggtgagggaaacatcagcctcgtgccgcacttcatccgcaaggagcagaagctggatgagtacaaggaacacaaattctccgacaatgaccggaagaacctccgcgaaacgggcaatctcggtagggtcgtggacattgtggacagggaaacgggcgagatcatcccctcctacatcagcatcgaccgcaagacgaatgaaatcacggacattccggcaagcagggtgcgcatcccggagcgcatcggcaagacggaaatcaccacgcaggagcgggacatgctccgcgccggactgcccgtacgcgacaagctcatcgagcgcaacgacggcagaaagttcgtcaccaccctgcaagtgaacgtggagcagcgcggcgtggagttcgtgccgggaaccggcaagtcgccccgtaccgcacagacacaggaaaccaaaggcgacacatcgaaaagtcaggcgcagggcggggaaaatgccgcacagaccaagaaggagcaacgccgcaacacgtggacgaacgaggacggcagcatccgccccatcagcaaatggagcggcgtgagcttcaccgaccagcagaaagccgactatgtggcgggtaaagccgtgaagctggagaacgtgaccgacaagcagggcttccatgccacgatgtatatcaagttcaacccggagaagggacgcccgtaccgctacgacacgaaccctgacaatgcacagcaggttgctccgtccaacgagagccgcacgcaggtggcggtgaacaacgatggcaagaccaacgaggctacaaagaatctgagagagccgttgcagaaaggtcagaccaacccgaaggacgcccgccagcaacagcagcaggagaagccgcagaagaaaacgggcaagggcatgaaaatgtaatcccgtgtccgccactgaatccaaaataaaatccaaagtatcaacaaaaaagaagaagacatgaagacaatcattgcagaaaagccctccgtggcacgtgaaatcgcccgcatcgtgggcgcgacaaagagagaggaaggatatttcgagggaggcggttatgccgtgacatgggcattcggacacctcgttcagcttgccatgcccgacggctacggcgtgcgcggatttgtccgtgacaacctcccgattattcccgacacattcacgctcgtcccccgtcaggtcaggacggagaaaggttacaagcccgacagcggcgtggtgtcgcagataaaagtcatcaaaagactgttcgacacaagcgaacatatcatcgtggcgaccgatgccggacgcgagggagagcttatcttccgctacctctaccactatacgggttgcaccactcctttcgtgcgcctgtggatcagctctctcaccgacaaagctatccgcgagggactgcggaaactcgaagacggcagcaaatacgacaacctctacctcgccgccaaagcgcggagcgaatccgactggctcgtgggcatcaacggcacacaggcgttatccatcgccgccggacacggcacgtattccgtggggcgggtgcagacaccaacgttggctatggtatgtgaacgctactgggagaaccgccgctttacgtccgaagcattctggcagctccatatcgcaacggacggttgcgacggcgaagtcgtgaaattctcatcctccgagaaatggaaagagaaagaaccggcgatggaactatataataaggtaaaggcggcaggttgcgccactgtcacgaaagccgagcgcaaggagaagacggaggaaactcccttgctctacgacctgaccacgctccagaaagaagccaacgccaagcacggcttcacggcggaacagacgcttgaaatcgcgcagaaactctacgaaaagaagttgataacctatccgagaacgggaagccgctacatccccgaagacgtgtttgccgaaattcccaaactgctcgctttcatcggcacacagcccgaatggaaagacaaggtgcgggcaaaagccgccccgacacgccgcagcgtggacgacggcaaggtgacagaccaccatgccctgctcgtcacgggtgagaaaccgctcttcctctccaaagaggacaataccatctatcagatgattgccgggcgcatggtcgaggcattctctgagaaatgcgtcaaggatgtgaccactgtcacggcggaatgtgccggagtggagtttaccgtaaaaggcagcgtcgtgaagcaaaccggatggcgtgccgtctatggcgaggaaaaagaggaaattaccatccccggctggcaggaaggcgacacgctgacaccgaaaggctcgtccattaccgaaggaaagaccaaacccaagccgctgcataccgaagccaccctgctctcggcaatggaaacggcgggcaaggaaattgaggacgacgcactgcggcaggcgatgaaggactgtggcatcggtactcccgccacacgcgcctccatcatcgaaacgcttttcaagcgcggttacatggaacgctgcaagaagtcgcttgttcccaccgaaaaaggacttgccctcaattccgtcgtcaagacgatgcgcatcgccgatgttgccatgacgggcgaatgggaaaaggagctggcgcgtatcgagcgcggggaactgtccgacgacaccttccgcaaggagatagaggcgtacacacgtgagataacctccgaactgatctcgtgcgacaagctcttcggcagccgtgactccggctgcgcgtgtcccaagtgtggcacgggcaggatgcggttctacggcaaggtggtacgctgcgacaacacggagtgcggactgcccgtgttccggctgaaagcgggacgcaccctgtccgacgatgaaatcaaagacctgctcaccgaagggcataccaagctgctcaaagggttcaagagcaaacagggcaagagtttcgatgctgttgtcgcctttgacggggaatataacacgacttttgtgttcccggaggctaaaaaggacaagaaattttcaggacggaagaaatagtattaactttgccacttgttcagagtaatgaattgttcttcgataccggattacactcatactttggatttagtggtggcactcggagggataccgagtgcctttttcttcctttttccaaccgattatcccgttaattatcaatccgctaaatccaaagtaatgaacaacaagaagaaaaacgagggtcagaccgacttttcctattacggtctgtacctgctggactatctccgcacgaacaagtttgaacaggctgacgacaccgctttcatacgggaacgggccgaccgtgccgccgaaacgtatgagagggcacggcttgaaggctatcccgccgatggtgcgcaggaactggcgatggacacgctgctgcgcgggctgcattattcccgttacgccatcctccgcgaagtcgtggaaaacgagtttgccgatgaagtgccggaagagaagcgtgaagcctttgtcctgaaactgctgccgcttgtcggcaacgtgttctccgtctatgacctctcggatgacaatttcgccctgtcttccgattacgacctgctctacacggagctgacgggagcaaccgtcctttacttagacgaatatggcgtttaaccgcaaacagaaactgcgggacaacatcgaggcgatacggacggcattcatccttgacagggaaaataggacagcgacaaccgaagagcgtgccatacttcaaaggtactgcggtttcggcggtctgaaatgtatcctcaaccctgcaaaggaactgacggatgccgtccggtgggcgaaatccgacctcgaactgttcgccccgacggtggagctgcacaggcttatccgtgagaacagcaaggacgaaacagagtacaagcggtttgtggattcgctgaaagcgtccgtgctgaccgctttctacacccccaaagagataaccgacaccatcgcggacgtgctggcagattacagcgtccgccccgcccgtatgctcgaaccgtcggcaggtgtcggcgtgttcgtggattccatgctgcggcacagccccaatgcggatgtgatggctttcgagaaggatctgctcacgggtacaatcttgaggcatctctatcccgaccagaaaatgcgcacctgcggttttgagaaaatcgaaagaccgttcaacaattatttcgacttggcggtgtccaacattccgttcggtgacattgccgtgttcgacgcggagtttcagcggagcgactctttcggcagacgctccgcccagaaaaccatccacaactatttctttctcaaaggactggatgccgtgcgtgacggcggtatcgtggcgttcatcacctcgcaaggggtattgaatagcaccaagacctccgtgcgtaacgagctgttcagtcaggccaatctggtatccgcgatacgcctgcccaacaacctgttcacggacaacgcgggcacggaggtgggcagtgacctgattgtcctgcaaaagaacctcagcaagaaggaaatgtcgcaggacgagcggctgatgaccgtgatacagacggacacgaaaaccgccctgaccgacaacgcctatttcatccaccacccggaacgcatcgtgcatacgatggcgaaacttgacacagacccctacgggaagcccgctatggtttatctgcacgagggcaaggcagcaggcatcgccggggatttgcgccgtatgctcgacgaggatttccattacaggcttgccatgcgcttgtattcgggttcaatccggcaggcaggaacggaagaaaaagttgccgttcaaaataaagtagagcgtcctgccataaaattggaaacagtatcctcggcgcagacggtggaaactccgacagaaaagccgcaacccgcagatgaaaagccggagatagaaccgcgcccgcaatattccgcaggcgtgcagctcaccctgcttgacctctgggggatgacggaagaggtcagccaaccgaaaacctccaaaaagaaaaagacggtgaaaaaggcagttacggcaaagtccactccgcccaaaccgaaagtcacggttacaccgacagctccaactgcaaaacccgcaatggagaataaggaggtgaaagcggagaacaccgccaagcctgccgacccggacgacatctatgccacactggactgggataccaatcctcccatcaacggtttctatgaaatgatgatgggtttgacgccggagcgtaggaaagaacttcgggaactggcaaggcagcataacgagaaacaagtggcggaaaagacggaagtgaaagccgtgccggaaacttcccgtgagcagccacgacaggaggaaacacagccggaggcagtcgccgcacctgccgttacagataccccatcggaagcggtggggactttccttttccccgacatcgaagcggaaaagccgaaggaggaagtcgtggacctttctccgcgtgcctaccaccgcacgccggagatgcacctgcgcgaagggtcgctggtggctgaccgggggcgtcataacatcggctacctgaaagacatcacgccatacggggcgacattccagccgctcgacctgaaaggataccagaaggaaaaggcgttgttgtatgtgtcgctgcgtgacgcctacgagcgtctgtaccgttatgaatcgctccggcgcgaggcaaatgttccgtggcgagagcatctgaatacctgttacgatgagtttgtcatgcgctacggcaacctcaacgccaagcagaacgtgaagttagtgatgatggatgcgggcgggcgcgacatcctttcgctggaacggatggaaaacggaaagttcgtcaaggcggacatcttcgagcatcctgtttccttcgcggtggagagccatgccaacgtaggctctcccgaagaagccctgtctgcgtcgctcaacaaatatggtacggtcaatctcgactatatgcgggagataaccgacagcacggcggaggatttgctcactgccctgcaagggcgcatctactacaatccgctcgtgaccggttacgaaatcaaagaccgtttcatcgccggaaatgtcatagagaaagcggaacgcatagaggcatggatgggtgacaatcccgaaaatgagcgtatgccggaggtgaagcaggcgttggaggctctgaaagatgccgagccgcagcgcatcgccttcgaggatctggacttcaatttcggggaacgctggattccgacgggtgtctatgccgcctacatgagccggctgttcgacacggaggtgaaaatcgcctattccgcaagcatggacgagttttcggtggtgtgcggctaccgcaccatgaaaatcacggacgagtttctggtgaaggggtattaccggaactatgacggtatgcacctcctaaaacacgccctgcacaacacctgccctgacatgatgaagtccatcggcaaggacgagcatggcaacgacatcaagatgcgcgacagcgagggaatacaactcgccaacgccaagattgacgagatacgaaacggcttctccgaatggctcgaagagcagtcgccgcagttcaaggagcggcttgtgacgatgtataaccgcaagttcaactgtttcgtgcgcccgcgctacgacggctcccatcagacctttcccgacctcaacctgaaagggctggcaagccggggtatcaagagcgtctatccctcacagatggattgcgtctggatgttgaaacagaacggcggcggaatttgcgaccacgaggtgggaaccggtaagacgctgataatgtgcatcgccgcgcatgagatgaagcgtctgaatttggcacacaagccgatgattatcgggctgaaagccaacgttgcggagattgcagccacctatcaggcggcatatcccaacgcacgtattctgtacgcttcggagaaggacttttcgaccgccaaccgtgtgcgcttcttcaataatataaagaacaacgactacgattgcgtcatcatgtcgcacgaccagttcggcaagataccgcagtcgccggaattgcagcagcgcatcctgcaagcagagcttgacacggtggaggaaaacctcgaagtgctacggcagcagggaaagaacgtgtcgcgggcgatgctgaaaggattggagaagcgcaagcacaaccttgaagcgaagctggagaaggtggaacacgccataaagtcacgcacggacgacgtggtggatttcaagcagatgggcatcgaccacatcttcatagatgagagccaccagttcaagaatctgactttcaacacgcgccacgaccgtgtggcgggattgggaaacagcgagggaagccagaaggcacttaacatgctctttgccatacgcaccatacaggagcgcacaggaaaagacttgggtgcgaccttcctctccggcacgactatcagcaactcactgactgaattgtacctgctgttcaagtacctgcgcccgaaggagctggaacggcaggacataaggtgtttcgacgcttgggcggcgatatttgccaagaagacgacggattttgaatttaacgtgacgaacaatgtggtccagaaggagcgtttccgctacttcatcaaagtgccggagcttgccgccttctataatgaaatcacggactaccgcacggcggaggatgtgggcgttgaccgtcctgccaagaacgagatactgcaccatataccgcccacgccggaacaggaggacttcatacagaaactgatgcagttcgccaagacgggcgatgccaccttgttgggcaggctgccgctttcggaaacggaagaaaaggcgaagatgctcatcgccacggactatgcccggaaaatggcactcgacatgcgcatgatagacccgaattacgaagatcatcccgacaacaaagcgagtcactgtgccaagatgatcgcggagtattatcaaaaatacgacgcccagaaaggcacgcagttcgttttctctgatttggggacataccagccgggcgacgggtggaacgtctattcggaaatcaagcgcaaactgacggaggactacggtataccgccaagcgaggtgcgcttcattcaggagtgcaagaccgacaaggcgcggaaggcggtgatagacgccatgaacgccgggacggtgcgtgtgctgttcggctctacctctatgctcggaacgggtgtgaacgcccagaaacggtgtgtggctatccatcatctcgatacgccgtggcgaccgtccgacttgcaacagcgtgacggacgcggagttagggcaggtaatgagattgccaaacatttcgccgggaacaacgtggatgtaatcatctacgcggtggagaagtcactggacagctacaagttcaacctcctgcactgcaagcagactttcataagccagctcaaaagcggtgcgatgggtgcgcgtaccatcgacgagggggcaatggacgaaaaatcgggcatgaatttctcggaatacatggcgttgctctccggcaataccgacctgttggacaaggcgaaactggaaaagcggatcgcatcgctcgaaggggaacgcaagtcgttcaacaagggcaagcgtgattcggagttcaagctggagtcaaagaccggcgagttgcgcaacaacacggctttcatagatgccatgacggaggactggaaccgcttcctgtcggtggtgcagaccgacaaggagggcaaccgccttaatataataaaggtggacggagtggattccgccgatgagaaggtcatcggaaagcgtttgcaggagatagccaagaatgccacgaccggagggttgtacacgcaggtcggtgaactttacggttttccgataaaggtggtgagcgaaaggatactcaaagagggattggagttcaccgacaaccgcttcgtggtcgaggggaactacaagtacacctacaacaacgggcatctggcgatggctgacccgttggccgccgcccgcaacttcctcaacgcgatggagaggataccctccatcatcgaccagtacaaggcgaagaacgaggtgctggagatggagataccgcagttacaggagatagcgggtaaggtgtggaagaaggaggacgagctgaagcagttgaagtccgaacttgccgcccttgaccgaaaaattcagctggagcttgcgccacccacgcccgaagtcgcagaaaaggagaatgaagggcaacagctcaagccggaagcggaagatgtgaggaacaggcaggcgcaatatcccgaaaatgcaccgccgcagatacgcagtccggcggatagtatcgttgccaaccatgtcataatcgggcgtccgggactgtatgccaaggaggaaacccggtccaaaggattgaaaatataacctaaggaattttatctgaagtattaataagggctatcccaaaaggtctaaaagtaaattttatcctttctgcaagtatctataggatggcaactgcatttttttctttttgggcagcccttattaaaatttattcttattttaggttatatacattcatgtccatttatgtaaaaaattcctgctgaccttgtttatgtcttgtcagtcaccatttgcaaaaccatatttgaccctcaaagaggctgaatttgataagtaacttgctacatactcataataaggagctaaatagaacacgaatgggaaatacacaaatgctaaactaaagaagatattggccaaaataaacgctataccgagagagaaacttgatttttcaacttcctaaaacggtgttgttcaaacatttctacttatttgtacttgccagttgaacctacgcttccctaataaaatgtctatggtaaaaagttaaaaaatcctcccacttttgttagatatatttttttgtgtaattttgtaatcgttatgcggcagtaataatatacatattaatacgagttagtaatcctgtagttctcatatgctacgaggaggtattaaaaggtgcgtttcgacaatgcatctactgtagtatattattgcttaatccaaatgaatattataaatttaggaattcttgctcacattgatgcaggaaaaacttccgtaaccgagaatctgctgtttgccagtggagcaacggaaaagtgcggccgtgtggataatggtgacaccataacggactctatggatatagagaaacgtagaggaattactgtccgggcttctacgacatctattatctggaatggagtgaaatgcaatatcattgacactccgggacacatggattttattgcggaagtggagcggacattcaaaatgcttgatggagcagtcctcatcttatccgcaaaggaaggcatacaagcgcagacaaagttgctgttcagtactttacaaaagctgcaaatcccgacaattatatttatcaataagattgaccgtgccggtgtgaatttggagcgtttgtatatggatataaaaacaaatctgtcgcaagatgtcctgtttatgcaaactgttgtcgatggatcggtttatccggtttgctcccaaacatatataaaggaagaatacaaagaatttgtatgcaaccatgacgacgatatattagaacgatatttggcggatagcgaaatttcaccggctgattattggaatacgataatcgctcttgtggcaaaagccaaagtctatccggtgctacatggatcagcaatgttcaatatcggtatcaatgagttgttggacgccatttcttcttttatacttcctccggcatcagtctcaaacagactttcagcttatctctataagatagagcatgaccccaaagggcataaaagaagttttcttaaaataattgacggaagtctgagacttcgagacgttgtaagaatcaacgattcggaaaaattcatcaagattaaaaatctaaagactatttatcagggcagagagataaatgttgatgaagtgggtgccaatgatatcgcgattgtagaagatatagaagattttcgaatcggagattatttaggtgctaaaccttgtttgattcaaggattatctcatcagcatcccgctctcaaatcctccgtccggccaaataagcccgaagagagaagcaaggtgatatccgctctgaatacattgtggattgaagacccgtctttgtccttttccataaactcatatagtgatgaattggaaatctcgttatatggtttgacccaaaaggaaatcatacagacattgctggaagaacgattttccgtaaaggtccattttgatgagatcaagactatctacaaagaacgacctataaaaaaggtcaataagattattcagatcgaagtaccacccaacccttactgggccacaatagggctgactcttgaacccttaccgttaggggcagggttgcaaatcgaaagtgacatctcctatggttatctgaaccattcttttcaaaatgccgtttttgaagggattcgtatgtcttgccaatctggtttacatggatgggaagtgacagatctgaaagtaacttttactcaagccgagtattatagcccggtaagtacacctgctgatttcagacagctgaccccttatgtcttcaggctggctttgcaacagtcaggtgtggacattctcgaaccgatgctctgttttgagttgcagataccccaagtagcgagttccaaagctattacagatttgcaaaaactgatgtctgagattgaagacatcagttgtaataatgagtggtgtcatattaaagggaaagttccattaaatacaagtaaagactatgcctcagaagtaagttcgtacactaagggcttaggcatttttatggttaagccatgtgggtatcaaataacaaaagacggttattctgataatatccgcatgaacgaaaaagataaacttttattcatgttccaaaaatcaatgtcattaaaataatggagcggtcaggaaatttctataaggcaatacggttgggatatatacttatctccattcttatcggatgtatggcatataatagcctctatgaatggcaggagatagaagcattagaacttggcaataaaaaaatagacgagctccgaaaagaaataaacaatatcaatattcaaatgataaaattttctctattgggtgaaacaatactggaatggaacgataaagatatcgagcattaccatgcacggcgtatggcaatggacagtatgctctgccgtttcaaggccacctatccagcagagcgcatcgatagtgtgcgcagtcttttagaggataaggaacgacagatgttccagatagtccggttaatggatgaacaacaatctattaacaagaagatagccaatcaaattccggttattgtacagaaaagtgtgcaggaacagtccaaaaagccaaaacgaaaaggtttcttaggcatattcggcaaaaaaaaggaagtaactccagcagtatcaaccactatccttcattcggtcaatagaaacgtaatcagcgaacagaaagtgcaggatcgccaattgtcggaacaagccgacagccttgcagctcgtaatgcagaacttaacagacaactgcaagaattgatttgccaaatagaagaaaaggtacaaaccgaactgcaaagccgggaaaacgaaatagttgccatgcgtgaaaagtcatttatgcaagtaggcggtttaatgggattcgttcttctattgttgttaatttcctacatcatcatacatcgtgatgcaaaaagcattaaacaatacaagcacaagacaactgatttgataaggcaactggaacaatccgtacaacggaacgaggcactgataacgtcaaggaagaaggcggtacatactatcacccatgaactgcgcacaccgctgacagcaataacaggctatgccggactgatacggaaagaacagtgtgaggataagtccgggcagtatatccaaaacatactgcaatcctccgaccgtatgcgggatatgcttaacactttgcttgacttcttccgcctggacaacggcaaggaacagccccgtctgtcaccctgccggatttcagcaatcacgcacacacttgaaacggagttcatgcctgttgccgtgaacaaagggctgtccttgtccgtgaagactggacacgatgccattgtattgaccgacaaagagcgaataatacaaatcgggaataacctgctgtcaaacgctgtcaagttcacagaagaaggcggtgtttctttgattactgaatatgataatggagttctgacactggtcgttgaagatacaggtacaggcatgacagaagaggaacagaaacaagcgttcggtgcgtttgaacgtctatcaaatgccgccgcaaaggagggtttcgggcttgggcttgccataatgcgtaatattgtgtcgatgcttggcggaacaatccgtttagacagcaagaaagggaaaggcagtcgtttcacagttgaaatttctatgcaggaagctgaagaacagcttggatatacaagcaatacacctgtttatcataacaataaattccatgatgttgtcgccattgacaatgatgaggtattacttctgatgctgaaagagatgtattcccaagaaggaatacactgcgacacttgcaccgatgctgcggcactgatggaaatgatacgccagaaagaatacagcctgttgctgacagacttgaatatgcccgatataaacggtttcgaattgctggaactgttgcgttcgtccaacgtgggcaattcaccaacaatcccggtggttgtggcaaccgcttcgggcagttgtaacaaaggggaactattggcaaaaggctttgccggatgcctgttcaaaccgttctccatatcggaactgatggaggtttccgacaggtgtgccataaaagcgacaccggacgggaaaccggacttttccgccttattgtcctatggcaatgaagccgtcatgctggaaaagttgataactgaaacagaaaaggaaatgcaggcggtacgggatgcagcaaaagaaaaagacctgcaaaagctggattccctgatccaccacctgcgcagttcgtgggaggtgctccgtgccgaccaaccgctgaatgtactttacggattgcttcgtggcgatgctctcccggatggtgaagcgttaagccatgccgtgactgccgtgctggataagggagtggaaataatacggttggcagaagaggaaaggagaaaatacgaagatgaataagacaaaaataattgtggtggaagacaacatcgtgtattgcgaatatgtctgcaatatgctgtcacgggagggctaccgcaatatgaaggcttaccacctctcaaccgcgaagaaacatctgcaacaggcaacagataatgatatcgtggttgccgacctgcgtctgcctgacggcagtggcatagaccttttgtgctggatgcgaaaggagggaaagatgcagcccttcatcattatgaccgactacgccgaagttaataccgccgtggaaagcatgaaactcggctcgatagactatattcccaaacagcttgtggaggataaacttgtccccctgatccgttccatactgaaagaacgtcaggcaggacaacgccgtatgcctatattcgcccgtgaaggttccgcctttcagaaaatcatgcaccgcataaggctggtagccgccaccgatatgagcgtgatgatatttggtgagaacggcacgggcaaggagcatattgcccacctgttgcatgacaagagcaaacgtgcaggcaagccatttgtggcggtggactgcggttcactctccaaagagcttgcaccgtcggctttcttcggacacgtcaaaggtgcatttacaggtgcggacaatgccaagaaaggatatttccatgaggcggaaggcggcacgttgtttctggacgaggtaggaaacctcgcgttggaaacccaacagatgttgctccgtgccatacaggagaggcggtatcgcccggtcggagacaaggcagaccggaatttcaatgtccgcatcatcgctgctaccaatgaagatttggaggtatcggtgaatgaaaagcgttttcggcaggatcttctgtaccgcctgcacgacttcgggataaccgttcctccgttgcgtgactgtcaagaagacattatgccgctggcagagttcttccgtgatatggcaaacagagagctggagtgtagcgtgagcgggttcagttccgaagcacgtaaagcgttgctgacacacgcatggccgggcaacgtgcgggaacttcggcagaaagttatgggtgctgtattgcaggcgcaggaaggtgttgtcatgaaagagcatctggaacttgccgtgacgaaaccgacctctactgtcagcttcgccttgcgcaatgacgcggaggataaggagcggatattgcgtgcgttgaaacaggcaaacggcaaccggagtgtcgccgcagaactgctcggcataggcaggacaacactatacagcaaacttgaagagtatggacttaaatggacttaaatataaattcaagcaatcatagcccgtaattcactgaatttggctatctttgcataacatttgagaaaaacggcgattggcaggagcttttcgccgccaacatataggataagaccgcaaggcgtttcaagcgaaaatctggtaaattggaactacggagacgattgcgtgatgcttatgctatgcttacgcatagcgtgcattcacgtactctccgtaaaggctttaccagagccatcgcttgaaggtagtgtgaattgcacgctacttttttacccttgcctaacgaaaggaaacgattatgggtaaagttcagattctcgccgtactgacgatggacggatgtctttcttcagagttatatgataaagcacatcaggatttgtgccttgaccgttgcggtcttgatgaaatcaggaagaaagccttttaccgtgtgacaccggactattccatttcaatgctgcacgaatggagaaaagactgcacaaacatccgttacctcgcggaagccacaccggacacggcagactatataaacggactgctgcggatgcacgctgtggatgaaatcatactatacaccgttcctttcatatccggaagcggacgacatttttttaagtcggctctgccagagcaacactggacgctttcctctttgaaaagctatcccaacggtgtatgtcgcattatctatatccttgataaaaaagcaagatagccaaaatgtgcggcaagcatacatttctattttcaggaatagaataaatgttccgattacaaacaatttaagtcggagataatttgtccttgtgaaaaaatactgaattttatacctctgaaatccagcactttgtaaaattgagtgttggattttttattttctgccgcgttttttgccaattatattcatgtgcgcacgcagaaaacaaagtgtaattttcaaaattgacagaaccatgaattatttcttgctggcggaaaccgactttttccgcctgataaacgaagccggcgactgcaatatggaaacggcatacacggctttcgccacccaagtgatcgaactgtgcaacggcggcatggacatgaaccttaccgtcatcgcgcttgcctacatcgaaatcgagttgcagcaccatcccgtacgtaatctgtcagaagaaaaaagagagattgccgcctacgtcagcaaggctctgtctttcgtaagaaagatgcagaaattccttgccacgccccaagtgccaccactaatatccgccaacaacgcaacagaaaccaccgccagccttcttcaatggacgggcaatgccatcgacctcgtggaacttatctacggcatagacgtgatgggctgcatcaacaacggcaatatgccgctcaaacagctcgccccacttctctataagatattcggggttgattctaaagactgctaccgcttctacactgatatcaaacgccggaagaacgaaagccgcacctatttcattgacaggatgcaggaaaaactgaacgagagaatgttgcgtgatgaggagttggagcggatgagaaaataaaaaaatatccattacatatgagaagacaggaatactcgtatcctgtctttttattttcatttaattatatattaattagcacaatatatgtgagtttttcattcctataaggacaaatttcagaaacgtatgtctggtaaattattgagtcatcatagtatgaacatatatcattactaaaaacaatgaaacaacttccataagattgtggttgtaaaaatcgccatttaatagcccgttttttttgtaaaattcgccaattaaaaaaatatgattatctttgcattatattttataaggtatggaaacagtaaatagaatacttcaagagaagattacagcacgaatcgcgcccaataaagcagtactgatttttggtgctcgccgtgttggtaaaacggtaatgatgcgtaaaattgtggacaactattcaggtaggacgatgatgctcaacggcgaagactacgacacattagcactattggagaatcgctcaatagccaattatcggcatttattggatggtattgatttgctggctattgatgaggcacagaacataccacaaatcggtagtattctgaagttgatagttgatgaaataccgggaataagtgtcttggcaagtggttcttcgtcattcgatttgctgaataagactggtgaaccgttggtcggccgcagtacgcaatttctccttacaccattctcgcaacgggaaatcgcacagacggaaacggcacttgaaacccgccagaacctcgaagcgcgcttgatttacggttcctatcccgaagtagtaatgatggagaactatgaacgtaaaacagactacctacgtgatattgtcggtgcatacctgcttaaagatatcttagcaattgacggcttaaaaaattcgagcaagatgcgcgatctactgcgattgatagcttttcagttgggcagcgaagtttcttacgaagagttaggtaaacaactcggcatgagcaagacgaccgttgaaaaatacctcgacctattggaaaaggtcttcgttatctatcgtctgggggcttattcgcgtaacctacgcaaggaggttacaaaagctggcaagtggtacttctacgacaacggcattcgcaatgccattatcggggctttctcaccgctggccattcggcaggatgtcggtgcgctgtgggagaactacatcatcggagagcggcgcaaagcgaacttcaatgagggactgcacagggagttctatttctggcgcacctacgacaaacaggaaatcgacctgattgaggagagtgccgacagtcttaccgccttggagttcaagtggggaaataaaatgccggccgcaccgaaagccttccaagaagcctatccctatgccgagtttcatgtggtaaatcgggagaattatttggagttcgtataatcaataaattacgtatatggaaacaaaactacaatccaaacagcaatatccgcggtttatccaaaataaaccgtgtggtattgacaaattcgatggaggttcgcaagaaaggttggcaaaaactattgctcgccatttttgtcagaatgattcattggatgaggaatgtactttacctcgaattatcggcatcgaaggtatttggggatctggaaaatccaacgtggttaaaatgttggaacgtgaattatcagacgactattacttttttgagtatgacgcatggggacatcaagaggacttgcaacgccgctctatattggaattgcttacaagcaaacttattgatgatggtatcctatctggaaatgcaacaataaaagtcaaaggtggaggtacgaaaaccgtatcatggtctgaaaagctgaaatatttattagcccgtaaaacggagaccgtaaccgaaaaatatccccttatcagtaatggtatggttgcggcatttttggttgcagttttaactccgatatttacatttattgcgtatgcagtaaaacctacacccacaacatggtggttttctttattgtctattatcatagctgcactgccagttcttattgcattgtgcgtttggaaatgggcatatagcaaagatcataaatatggatggagttatatgttagctatttatcaagataaagtcgaaaaggacgtttgctatgagactttgagcgaagacgaaccaacggtttacgagttcaaaacatggatgcaagacatttctgattttatcaaggaaaaaggacaacgtaaattagtccttgtttttgacaacatggatcgtctccccgctgaaaaagtaaaagaattatggtcttctatccatacgttcttcgccgatagcggttttgaaaatgtttgggctgttattcctttcgatgaaacacatttagcttgtgcattcggagatgagaccgacgaacaaacgaaacaactgaccaagtattttatcaataaaactttccctattgtttatcgtgttgctcctcctgttattaccgactatcgaagtatattcaacaaactgtttgttgaagcatttggagaaacagaaaatgaagcgaaagaaactataaatcggatattcagattggtaaatcctaatgccaatgttagggaaattatatcatatatcaatgagatggtcgctcttaaacaagagtggtgtaacgaaattttgatgataaacatagcattgttctgtttgaagaagacggatattctggcaaatccagtagaacaaatattgtccggcgactatctgaatggcattcaaacaataattaacaatgatctgcaaacacaacgcgaaattgcagctttggtatatggtgtcgatgttgaagatgctcgacaaattccattgaaaaaatatattgaaggctgcatcaacggagaagaagaccacgacataaatcaatatgcagagactaataaacaatttgacactgtattagaagaagttatacaatgtatggacaatgcgcttatcgataagattatacattgtttgcataaattaactcgaaagagcgatgttattctgcgtgtatggcaaagaatagcacaattgaaattaaaagaatccatagagaagcaggtgttccctgtcgaataccaagaactgctgttgcatttagacacggaaagccaaaaccatgtgattgctcaattatataagaagatagttcggttcaatgacttcaatggcggcgactatttcaaaacgttagatgcaatagacaggtttattgcgcaaaataagttggcgtgcgattttacgtcattgattgaagcaaaaacagtcaagccaaatacatttatcgattatattcaagctgcaaatgcaacagatgctgcctatcgggataacgcgacaactaaagcatataaatattatcaagtagcaacaaattcggaggcgctcgataattatttggcaaacttactacccgataatttcgaccatgcagatattgtaaaaacgttaaaagataattctacctatacgtttccaacgcttttgcaagcgatcacgaattgcattgatgaacagaatgtaaataaagataatataggggctatatttacaacctatcgtttattggcatctgacgaagaaagacctttacctgtaacgttagattcaacctacataaatcagttgcattctgaattagaaactgatggccgaaacattaaagagtctggatattacgatttagtcgccatgcaattggcacatggtcattccgtttccttaatagagggtggagatataaaatatgttgcagaactcatggactattatgtggatcatggagacttattagtaaatagtgtgggatggaatataccgctattaaatgaaacactacaatacatggtaaatcataaacttggctataaattattgctctcagacatattgccccaatttgaagatattaagaacagaataggtgtaacggatgaggtatttatcgagcatttagcagagtggaataccgatttggataagtatatcactaagaacaatattaaagatgtaattcctgacgcatctttttacgatttgaccactaaaataagcaatgtcctgaccgatcatatcaataaaatagcgttcgaagcgttgtctgaaataagtgttgatacattatacgcccaaagaacagcacatacatcatattattggtttgtcgcaataaaacatttactggctaaaatcaaatccttgccagataacttgactgaatttggcaaaaagattctgatggatattgcttctggaactcaaagtttgaatcctttccctaattgtttcaagaatatagttgaaagattggataaacgaaaaattaaatcgacagttaccgatataagaaatgatttctgcatcggtaaaaagactatcaatgcaataaagtttcaatttttcgaaacatggcttagatcgcatggtaatttgaaaagtcaagctggagacgttattgataaaatagtgaaacctgtaatttccgatggggcatgccgttcattgattctgcaaaacaaagatttttatatggatttaataaatacagcaggggatgatgcttatgaattgaaaaagagtctccgaaacctcatacaaaaagattcagatccgcaattggttaaatttgtcaattcgatagattcagtacctgaggttgaaaccgcgtaagtatttgtctaacaagtccgaattttacgattttacccgtcagaactgaagtgccccccaaaaaaattgtatccaacttttgggggtcacttcaaacttcgatagggataattttcaattttggggacttgttagacagtctcattatctggtagcagtttacacagcaccggatcgtttttgatacgctccagttcctcctgcacaatctgcttcacctcttccttgatgcgccggtagttcgcctgcaccgtttccttcatgcggtcgttgccgtcctcgtccgtgaagtttgtaatgacgggaattttcttgtaggcactttcttcccgtttcaccttttcggcatccaccacaatctcgcaatgaaaaatcttctgctcgatacgctcgttgaagttgtcggatacagaaccgacaaacattccctgcgtaagcccggaaatcttactcggtggaatgagcgcgtccatctgcgtgttgatggaggtggaaacatcctgccggttgatggagatggactgccgtttctgcaacaccttaccgaaccgctcggagagcgtcttggctgtttcccccaccacctgaccggagaaaatattgccgacagtgttcatcaccactttcgcctctttgtccccgtagtcacgcactaactggctgaaatcctgaaagcccagacacacggcaaccttgttgcttcgggcggtagctataagattgtccaaccctttgaagtatattgtgggcaactcgtcgatgatgaccgatgacttcagcatccccttcttgttgatgagcttcacgatacgggaattatacagaccgagtgccgcaccgtagatattctgacggtcgggattgttacccacgcagaggattttcggctcttcgggattgttgatgtccagcgtaaactcgctgtctgacatcacccagtagagctgcggtgaaatcatcctcgaaagcgggatttttgccgacgctatctgacccatgagctgctccgcagcccctccaagccacgcatccatgaacggcgaaaggtagttctccagctccggataagaggtcagtatcggaaatatatcctcgtaacggcggttcagaaactcgatagcatggggaaacgtgcaaaacttcccgttctgatagattttgagataccagataatactggcaaacagaatgataggtgactccacgaagaagtcgccctgcttttgcacccacgttttattgaggttgagcattattgtgtaggcactctcataggcatccgtaatatcttccataaaatccgggtgaatgggattgcaccgatgagagcgtcgcgggtcgtcgaagttgatcacatagaacttcggctttaccttgtagccgtccgggtggttcagcaaatggttgtaggcaatagtagataggtcgggatacttgaaatcgtagatgtattgactaaagcccttttcaatctgttggtcgggtaggtcagctccctttcgggagctttcccccctaagaaccgtacatgttggaaacaaagataacaatttataaatttacccctcagctttttacattgaccctaaaaatgcacaagcattcgcattatacctactaatagtgatgcatagctcacaaaaaaggagtacctttgcagccctaaatcatcattaataatgacagtatggaaatgaacaaagtttttaaggatggattgtggagtaaggaaattaatgtttcagacttcgtatataccaacattaccccttatgagggcgatgcctcattcttggcaggccccacagagcgaactaaaaaagtgtggaacgaatgcctcaaggcactagaagaagaacgtgccaataacggagttcgttcccttgataatgtaacagtatctactatcacctcacataaagcaggatacattgaccgtgaaaacgaactgattgtaggtcttcagacggacgaacttctgcgccgtgccatcaaaccttacggtggtatcaaggtcgtagaaaaagcctgccatgaaaacggtgtggaagcagatgaaaaagtaaaggatatctttactcattatcgcaaaacccataatgatggcgtatttgatgcttataccgaagaaatccgctctttccgttcactcggtttcctgaccggtctgcccgataactatgcacgcggacgcattattggtgactaccgccgtttggcactgtatggtatcgaccgactgattgaagcaaaacaagaagatttgcgcaatatcaccagtccgatgaccgatgcccgtatccgcctgcgcgaagaagtagccgaacaaattaaagcactgaaagaaataaaaatattgggtgaatattacggactcgatttgagccgtcccgctactaatgcacaagaagcggttcagtgggtttatatggcatatcttgctgccgtgaaagaacaagatggagcagctatgtcattgggcaacgtttcttcattcctggatatctatattcaatatgatttggatcatggtaaaattgacgagtcattcgctcaggagctagtggatcagtttatcatcaagttacgtatggtccgccatctgcgtatgcaatcatacaatgacatctttgcaggtgaccccacctgggtgaccgaatctatcggcggacgattcaacgacggacgcaccaaagtaacaaaaacttctttccgcttcttacaaacactatacaatctgggtccgtcacctgaacccaatatgactgtactgtggagtccggagttgccggaaggtttcaaagaattctgcgcacaggtttctatcgacacttcttccatacagtacgaaaacgatacgctgatgcgcgaagtgcgtaactgtgacgattatggcattgcctgctgtgtgtcttatcaggctatcggcaaacaaatccaattcttcggggcacgctgtaatctggctaaggctctgttactagctatcaatggcggacgttgcgaaaatacaggaactgtaatggtgaaagatattcctgtattgacaggagacttgctgaactttgaagaagtatggtctaattataagaaagtattaatgcagattgcacgtgtgtataatgatgcgatgaatatcattcactatatgcatgacaaatattattacgaaaaggctcaaatggcattcattgataccgatccacgtatcaatctggcatatggcgtagccggtctgtccattgccattgactcattgtctgccatcaaatacggcaaggtacgtgccaaacgtaatgatataggtttgactgaaggctttgatattgaaaatacatatccttgcttcggtaatgatgatgaccgcgtagaccacttaggagtagatttggtttatttcttcagtgaagaattaaagaaacatccggtatacaaaaacgcccgtcctaccctgtcactgctgactatcacctccaatgtaatgtacggtaagaaaacaggtgccactcctgacggtcgtgccaaaggggttgctttcgctccgggtgccaacccgatgcacggacgtgataagaacggtgccatcgcctcattgagttctgtagccaaactacgctatcgtgatgctcaggacggcatcagtaacacattctctatcgtaccaaaatcactaggagtggatcgggaaacccgtatagagaatctgataaccatgatggacggttatttcaccaaaggggcacaccacctgaatgtaaatgtgctgaaccgtgaaatgctggaagatgcaatggagcatcctgaaaaatacccgcaacttactatccgcgtatcaggttatgccgtaaatttcatcaaattgagccgtgaacatcagctggaagtaatcagccgttctttccacgaaagaatgtaacatcacatatacattaatcgtaggggcgggttttaaacctgcccttaccagtttaaagacaaaccattatgatcagagtacattcttacgagtcaatggggacgtttgacggtcccggcttacgcttagtcgtatttttacaaggatgcaatttccgatgtctctattgtgccaaccccgacacaattgacaccaaaggtgaaagtacggaaacggcaatagacgaaattgtgcatatggctgtcagccaaaaagcttttttcggtaaaaaaggaggtgtgactttcagcggcggcgaacctacattgcaagcaaaagcactgattccgttattccagcggttaaaagaacaaaacatccacatctgtatagataccaacggcagtatatggaatgaggaagtagaggaactgctaaaatggacagacctcgtattattagatatcaaggaatttaataatgtgcgacatcggcaactgacagaacgtagcaacgaacaaaccatacgtaccgctgaatggcttgaaaaaaacggaaaacctttttggttgcgctacgtattagttccaggctatagttcctttgaggaagacatacgggcattaggagagcacttcaagaactatcacatgattcaaagagtagaaatactaccttatcatacattaggcgtacacaaatatgaagccatgggaaaagaatacaaactgaacggaataaaagaaaataccctagaacaattggaaacagccaaaacgttatttggtgaatatttcaataccgtatatttaaattagaaaagacaaacttaccgtctatccggtacttaagttccgttaaggagatgagccccataattttcgcctcatctcctttttatgtataagaaacaatatatttatatcagcactaccatcacatcccgtgccccatgagcacccattaccaaggcctgctcaatatcagctgtctttgacggaccggaaataaaggttccgaaaccatattcgcctgtatctatcagtttatatgcttcatgcatattgttcacaatcttattcttatctagaagaataaccaacttttcggcaataaaataaatggcacgctgctttacatcctgctctatccataccccaccattctccgcaaccccaatctttccatctatgacagccaaatccgtcccattcaattctgcaggatcttccaaatcatcgggattaaatgttgcacaagtaatactcttcagattagaagcgatgcgtttggctccaggataagcttttttaatgaaatcattcacgttctcctctttttccaaaaaaatggcttctcctcctacttgcttcatgacgaaataaaactgttctaccatactgggataagtcaatgccatatcttccaatggctttaaatccggtttctcatattttacatgtgtagcacgccggatgctctgcaatatatcttctctgctgctcataatttacttcactttacctttcttccacatttcattgaaactctccttagcaaatttcggcatttcacgtcctttcccccagtcattcaatccgttatagataaggaaacgcggcactccgtttaccaatggcgcccattttaatgccatattgaatatcgaagggcggttcatcatgaattccatgccaccggacattacctttttcatccggtctgccttacccaatttatccaaatcctggcgccacaaatagatctgctccgccaaatccactttagccggacatacaaacgaacaggaataacacaaagaacaagccgacacattgtcataataatgtaacggcgccttcaacatccccaggttaatcccgatagggccgggaataaaataagtataagagtaccccccactacgtctatatacaggacatgtattcatacaggctccacaacgaatacaattcaaagtcttgatatgctttgggtcggctaatatcttactacgtccgttatctacaataataatatgaagttccccaccctctctaggctttcgataatgagaagtatatgtagtaatgggttgtcctgtagccgaacgggccaacaaacgggtgaacactcccaatgattcacgatccggcacaattttttccataccaaaagccgcaatctgtaatttaggctgggaagtacccatatccgcatttccttcattggtacataccacaatctcaccagtagaagctacagcaaagttagcacctgtcatagccgcctcagcatgaataaatttctgacggagatttttccgggctgcatgtgtaaggtaagtagggtcaaaatttcctttctccgtacccatctctcgctcgaaaagctcacctacctgttcacgtttgatatgaatagcaggcaatacaatatggctcggcttcagatgcatcaattgcaagatacgctctcccaagtcgctttctaccacttcaatccctttgctttccaaaaaaggattaagttcacactcctcggccaacatggatttgctttttataaaatgcttcactccgtgctggttcagaatattgtagacaatgttacaatactcatccgcatcctttgcccaatagacatgagctccgttagcacgcgcattgttttcaaactccaccaataattcgtccaaatggctgttactatatagtttagtagcacatgccatattacgcaattcctcccattcgggaacttctttactcagtctgtcacgctttgccctaaccagccaaagtgtttcgtcatgccatgcggcctgtttcttgtttttcagaaactccgcagctgcttttgaatgtttcgtactcataatcctgccgctaagatttcaacaatgtgcaatgtcttgataggaagtttgtcacgggcaatgataccattctgatgcatcaggcacgaactgtcggcccccacaatgtattcagcaccggtagcaatatgacgcatcaccttgtcatgccccatctgcacggaaaccgcatcttcctctacggcaaacataccgccgaaaccgcaacattcgtctttgcgttccggttccacaacttccactccttctaccaaagagagcaaatcacgcaatttgctgaaataaggaatattaagttcgctggcagaagaaagtttcatcaatctcactccatgacaactgttttgcagactcactttatgtggaaacttggctttcaacgaagaaggcttgacgatatcatgaataaactcacagatatcatatatcttaccttcgctggcacaccgatgtttgtcttctttcaacagacgactgtagttatcacgcacaaaaacgacgcaactggccgaagggcccactatataatcgtaattcttaaactgttcgtcaaaatgacgggccaaatctaccgctttattctcgaaacctgcattcgccatcggttggccgcaacaagtctgattgagaggataatccacatccactcccaaacttttcagcagcttgtacgaggctatccccacctgcggatataccgcattgatataacaaggaataaataaacctactttcattgtcattagttaatatgtgtcctatattgaataacaaagttagaggatatttgttaagaaaacaacgagatttctaacgaataatgaagcggaataggtaaaaaagcataatattgtgagcaaaagccttactaataaaaaagtactccccgcgaatcacttcgcagggagcacttttaactaataactaactttgtggtttacgtaatttctatatgactaacttatagtgcaaagatagaggttagggaccacatccacaatcacttcatttaggtattctatcttattccactcaccatttgtaggtattataagttcatcttcacctcgcttagttcaaccagtttatttacgatagcgtaaatagtcaatccggcaggtgaatgtatctgtagcttgcgcgcaatattccgacggtgagttatcaccgtatgaatggagaggaacagtttttccgccgtttccttatttgtcatcccacgtaccacgcaacaaataatttctttctcacgctggctcaacgcttcctgttcgccatctgtttcatccacaccaagattcatcaggtctactaactttttatttaaaacttcgatgtcatcatatagcgctatactctcatcgtatcccttcaacagattggtatctgtgactgaacacaacaaagaaacgcatttgacagatgcctgtggatagttcgatttgaactcgtccacgttaaaccatcctccgaaagtaggatttatgattagaatatccggctgatgtccctgcatacaattttgcagtccttcaagagaagttatttccaccggctgtattataagatcaggcatgcgcttcagcacagccacaagtccgctacgcacaatgactgaagtttcggccaccgcaacgtgcacaagttctgtccgtttcatttcccctccttttccagcctaagtacagcaggcacaaacaagtaatcctctacgcggcaatgagatgccaaatcttgttcacaactgaatatgtcgaataatacggcgttcaacaaatggttatttccttttgccggataatatttaataatgatgttttttaactcagtcagtgtcgcatctatctgatcatgcctgcgggcaaactgtgagatacggaatcctcccgtttctcgtcccgtcatcagattctctacataagtaaacacattcatatcttcataatccatgtgtttacgcacttctccggcatactgatcaaaaaatttcagaatgagaaatgcaacctcgttttccgtggaacaatctatagcttctatcaatttacggcgtatggtaggcagacagaaatcaaggaaataatgatgtgcctgttttaaataattcatcaatgaaggcatagaaatatccttcacatcatcctccatccggtcgctatcttcaatcatgaagtttaccaccgcaaggaaagtacgacaatccactccattttcacggcacacctcctgtactgtcttgtctccaaaccctaacgaaagatcaaaacggctcattacctgtagcaatgtatagttatcacagataagataactcattttgtccgtcagagtatatttacttgttttatacatagttatgttttttgtttctctttatggccgcaaagttacggaaaatcaccagggttatcaatcactataaataggtattttctcttgtacccataattcccgttcaaccggccaatgccagtcttttaattatacattaatatatagccgttaagataagtggcaagaagcaaccacaaaagataaggaacaaaaagatatgccgaagatttcctcaccggataactttctatcatataataaataacaagcacatccagcaccagaatatttgcaaaacctagcaacggactccgaaaataaaagaagaaaatgctccatgtaaaattaaacagaagctggaatccgaataatctgataatcatttgtcgtcttattgtccatatatgccaaatcaacccgatagaaattcccatgcacagatagataaaactccaagcaatgggaaaagctatatcagggggggtacaagaaggtttttccaatgcaggataccagttgagtatagactccgactgaaaataagaagcagtacagcctacactaaaacagataagtatagcaatcagtatggggattattcttttcataaggagaattatttctatttatgccataattaacaaaccaacctccggatttgttgcagaaacagaacacttctcccctgcaggtatctaaaaaacgtgctcccattcgttcgcttacgatgggagcacttacaacacaaaaactaaactagacttaactaaactattctattaagaagtttcacaacttcccttgtctatgctgcaaatataaaaagattatttcttttttgcaaaaggatatcgacaaaatatcaacttttatcattcaaatatcacatttttcaaacagaatgactattcaaatatatctgtaactcctgtttataactatcggaaatcggaatatactctttaccgaaaacaatccgcccccgatcaagcaccttaattttactcttttgcactataaacgagcgatgtacgcgaataaaacgactggaaggaagcttctcttccatagctttcatactgataagtgacaggatagctttcggctcatcctccacatgtattttaatataatccttcaacccttctatatacaatatccggtctaaagcaattcggagcaatttataatcactttttacatatatacaatcatccgcctcatcggcatcaacaccattatccgccttttgtttcaattcataccattgcaccgctttattcactgattgcaaaaaatcgacatagctgataggtttcaacaaatagtccaaggcattgactttataactatccaaggcatactgtccgaatgcagtagtaaaaataattcttgtttcaggactgaccatgcgtgaaaactccaaaccgttcaactcgggcatttgaatatcaaggaacaagacatgcacctcctcgtgaagaggaatttctgtcatagcttgcaccgcactggaatacctccctaccaaccggaggaaagacgttttttccacatagcttttcagcaattccaaagccagcggctcatcatctacaatagcacaattcagtatcataaacttttagtctgtatagttaatatagaagaatatacctgtccgttttcactgatcccttttatccattcgtaatgtcccggataaatcagttccaaccgcttgcttacctgttccagccccactccacttccacttttatcttgcccggacttcggatgattgctgttaaggatctcacatctcaccgtaccatccgtatgcccaaagatagagatactgataaaactgtctaccgtggggctgataccatgcttgaaggcattttctatcagcgatatgaaaataaggggagcgatttgcaacgcacctccagaatctgcctccaaattcacactcacttctacctgctgtggcaagcggatacgcatcagagctacataattacggataaagtccaattctttttcaagcggaacaaaagtctgctgattgtcataaagcacatgccgcaacaatttactcagctcttgtactgcctcttgtgccttgtcactattaaaagcaatcaaagcatagatattatttaatgtattgagcagaaaatgaggattcaactggttcttcaagtttttcagttccgcttccgtcttttgtctctccgcttctatcaaccgctcttccgcctgacgccaacgcaggctggtacgaatggccgcacccaatccggcaacaaaaatcatcatccccatatcccgcgcataaaatatccaacggggcggaatatgacgtgcaaactcaggaggcggaggagcgcttatactttccagaaatacatgaagaagcacactcagacaaagtatcagcacggcattgctcagaatatacttacgcatttcgtccgtgaacatatagcggggaaccagacacaagtaattgacatagaagataataaaatagcacaaaggaacacaactatgcctcaagaattgggccagattgaagccgcttccacggtccatgaatacaagcggaaagccaaaaacgagcaaccaactgacaatatggatactcatttccaaaaaacgtcgttgtgaaaataactgtttcatacaggcaaagataagaaagattagattagaaataagatttccatgattcttattccataaaataagactggcaggaatcagtgaagcaaaattgatttacaaaaaacattataaacagataatcgggaaaagaccggaacccaactagcattcccataaatcaattctgcttcacccccacaccttttcatccctactcgtaacgcaaagcgtctatcggatccaaatctgcagctttcttcgccggataccatccgaaaaacacaccggtgacggtacataccagaaatgaaagcaacacactccaaggctggataaatacaggccaatgtgctatcgttttaatcataaaactggctccacaaccgataatcactcctatcagcccccccgtgatactgatcaggatagcctctatcagaaactggctcaggatatctactcctcgagccccgaccgacatacgcaaaccaatttcacgagtacgctctgttacagacacatacatgatattcatgataccgataccaccgaccaccaaagatataccggcaatacaagccaacaaggtagtcatcaggtctgttgtagtgttgagcatactactcagctcctgctgggtgcggatggtaaagtcatcatcatccgtttctttcagcttatgttcacgacgcagaatggtcgttatctcatctacagcctcatcggtcatatcttctgtcagagccgaagcaaaaattccacttaggtaagtctgtgccagcaatcgtttcatcaccgtactgtaaggagccagtaccacatcgtcctggtccatgcccatcgagttatacccttttgatttcagcacaccaattacccggaaaggaatttgattacaacgaatcactttccctatcggatccgatccgtcgggaaaaagattatcgacaatggttttaccgataacacaaaccttggctgccgtacggatgtcattctcggtaaacatctccccctgttccacggtgagctgacgtatggtaagataatccatacttacaccactcaccgaagacgggtagttgttggcccccgcaacaagttgtcccgaagaagaaacgttgggactaatgccggagagattagtacactcttcgctcaacttttcataattttccagtttcagtgtctgcatggccgaagggtcttggcggacccctccacgcatctctgctcccggatgaatcataatcatgtttgaccccatctccgagatttgttgctggatgctctttttcgagccctgaccgatggcaagcatagcaatgactgatgccacaccgatgatgatccccaacatggtgaggaaagcgcggagcttgttgttggcaagagcccggagagctattttaaatagattcgttccgttcataatgattcttttttatggttagtcctcatcattcttgggcaaggcagccagcgcggcagcggccgaaagtatctgaggattgatggtatcttccactacatgtccgtcacgcaagcggatattacggctgctatactgggctatttcgggattgtgagtgacaaaaataagtgtacggccttcggcgtgtaacttttggaaaagtaccagaatttcgaaagaggtacgggtatccagattaccggtcgcttcatcagccaaaataacggcaggattattcaccagagcacgggcaatggccacacgctgcatctgtccgccggacatttggttggatttatgttccaaacggtcacctagccccacggctatcagtgattcaatggcacgtttccgtctttcggaagccgatacggacgagttatacatcaagggcaactccacattctctacggcagtcgtcttaggcaacagattatagttctgaaatacaaaacctattttacggttgcgcaacacagcccgctgaggtttgctcatggtacgcacggacacaccatccaacaggtattcaccactggtaggggtatcaagacatcccaaagtattcagcagagtggacttgccggaaccagaagtacccatgatagtgacaaactctccttcataaatggtaaaagagatgccacgcagagcgtggacggtttcatcgcctacctggaagttccgttttatattttgtaattcgattatctttttcatatgatttattctttcaatgtaaacggaagcattaccttttattacttgttctttttcttattgcttcccggagggcctggcatgaacggacttctctcaccttctccggcagacggctcttccattccaggcatagcacctttcactaccgtttctgtcactaccggcgtattttcagtgatgccactcacaatctctgtcttgctgccatcagtaatacctattttcacaggatgggcggtaaaggtattgttatccagtgtccacactttatgactgctctgacaatcgtttatcttacgacctcccactatgtctttgttgggagtaaagcgcaaagccttgttgggaacggtcaacacattatccttggtcaatgtataaatggtagcgttggcggtaagacgcggtttcagtttcaaatagggattatcagctgttatcactacctcataagtaactacaatggtactggtggttgttgaagagctgctgctcgtgctgttcgtacttcccaaacgaacctgtctgactactccttcgaacacatcgtcgggataagcatccacggtaaaggttacacgggctccttcctccaccccggcaatatcggcttcatccacatcggccaccacctgcatcttggtcaagtcggcagcgatggtgaacagtgtcggagtttcgaaaccggatgctacggtctgtccttcttccacatcacggctggtcaccactccatcgataggcgaggtgatggttgcgtatgacaggttacgctcagcctttgccagagccgccttgctttgctccaatgcactttgggcacgttggaaattataaaccgtttcttcatagtccatatcgctgattaattgcttctcgtgcagtttacggttgcggtcatataatttcttttggtaatcgtactcggcctcattgccgtcataagtggcctttgccgactgaagttcactttgcagtgtcactttatccatctcggctatcaattctcctttctttaccacagaattgtaatccacataaatcttgtcaataataccagatacctgcgtacccacttccacctctgtcaccggctctatggtcccggtagcagtaatgaaattgctgacattacctttcgttacggtttccgttgcgaaatcgaccgtactttttccctccggtccgccaagcatccagtaaccgcctgccacgaccactacggctaccgctgtagtaagaatcattttcttcttttccataatataatatgtatagcgttatgattataattttatatcctgacctgcatagaagttcagtagagtccgatccaagatagccatatacttggcctgaatacgttgctgctgtgcactgagcaggttatttttctcggtaagcaactctacggtattcttcattcccaagttgaattgctcgctgaccatctcataactggcctggctacttttcagcttactctcagccgccgcatattgctcttgagcattagtagcgtccaaccacagactttctatattcttatagagttccttttgcttgtttatcaaatcgagtagactactatcatattgcaaacgtgccttctgcacagcacttttgttctggcgattatcaaaaatcggaatgtttatattcaatcctatcatattattccagccatatttcatttgtttgctccagctattatcactggcactgtttgtcatactccccgtagatgcactcagactgatggtagggagatagccggctttagccactgatatgtccaatttggaattctctatgctcaacttgctgctttgaatttccggacgtgatgccaaagcctgctgataaacatcctcctgagcaggtaacggttgcaaaacatgttcatcggcgaattcgggaagaaccaaatccatttcttccgtaccatccagctccaacaactgcttcaactgcaatttatagtcacgcaaggaactttcggagatcaccaactgatatttgtcactgcctacctgtgattccaattgtgccaaatcggcttttgaaatacttcctttatgaaagagttctttgcccctgtcgtatgtagcttggctcacctgtaaggtgttctggttaattttcaccgactcgtcggcataaagtatctggatgaatatttgtgcaatctgctcttgcaaagagttttctgtttcggctacggtaagccctgcaatctgctgactcgtcttcttttgtttgatggcattcaaccgtttgttaccattccacaatgtccattgtgcattcagaccatagtttccattataagtggttttactgtcactactgatgatttccgttccgcttaccgtgttactggtttcctgatacggacggttcgtcacattctgtcctgtactgaacgacagactgggaaatagtgcggctttggcggttttcacgtctacagaactctcttccagtgagattttgtcctgctgcaattggatatttttctccaatgcatagtcaatacagtcgtccagcgtccactttttggcctcttgcgcggaaaccgaagtgaccgcgacccaaatcattacgaaatatactactcgttgtctcatcctttttactatttaatttgtttgtacaaaagtagaggactgtgatttttttagcaataaatatagatttgtggaatatttctatggacaaaaacttgctttttaccgataaagtgtttttctttgtaattattacaactttaagataaatttatgaatgattctttgttgacacgcatctggatattctatcgcgacggctttcgcgagatgaccttgggacgtaccctttggacgattattcttatcaaactattcatcatgttctttattctaaaacttttcttctttccctccttccttggcgggaagacaacggaagagaagcaacagtatgtaggtgaggagttaatagaacgggcaaatccataaacatttaaataaatcagaaagttatgtttgaaaacattgacacttcattaattgactggtcaagagcacagttcgctctaacggccatgtatcactggcttttcgtacctctcactttgggattagctgtgataatggggctcatggagaccttttatgtaacaacaggtaaggaattctggaagaacacagctaaattctggatgaaactgtttggaatcaatttcgccgtaggtgttgccaccggtctgattctggaattcgagttcggaactaactggagtaactattcctggtttgtgggcgatatcttcggagccccactggctatcgaaggaatcctggcattttttatggaagccactttcattgccgtcatgttcttcggctggaacaaagtgagcaagcgtttccatctggcatccacctggctcaccggactgggagcaacgatctccgcttggtggattctggtcgccaatgcctggatgcaataccccgtagggatggctttcaatcccgaaacagtaagaaatgaaatggtggactttgcagctgtcgccctctctcccatggctatcgccaagttcttccacacagtgttaagcagctggatactgggagccgtttttgtagtaggaataagttgctggtatttactgcgcaaccgtcagaaggagttcgctctgagcagtattaaagttgctgccgccgtaggtttgttcgcctctctcgtcactgcatggacgggggatatttcgggagtacaggtagccaaagtgcaacctatgaaaatggctgccgctgaaggattgcatgatggcggaaacggagtacccttcaccattgcaggcgatttgaaaatccccaaaatgctttctatccttgccactcacgacatagacggttatgtaccgggtatcaacaatctgctggaaggtggttatcagatgcccgacggtacaacggctttatcggccgaagagaaaattaaacgcggacagattgccatcgccgccctggatgcattccgcaaagcgcataaggcaggtgacgaagcaagtgccgcagcagctcgcaagacattggacgaaaacgtaaaatattttggttacggatatatcaaggatcccgcccatctggttcctaatgtaggacttactttctggtcattccggatcatggtggggctgggaggttatttcatcctgttctttattatagtactgattgtatcgaaaaaagagaaactggctgatatgcgatggttgcaacgggtggctttgtggactattccactagcctatatcggcagtcaggcaggctgggtggtagccgaagtggggcgccagccatgggctatacaggatatgttgcctgtaggagcagccatctccaaattgcagacaggttccgtacagcttactttctttatcttccttctattgtttaccgttctgctctttgctgaaataggtatcatgctgaaggccatcaagaaaggaccggagggaattaagaattaaggaataaatgaaacaggtggaaataattcaggctgcgcaataaatgggctacatacaggagattaattccgccatcaagtcattctttttttagttcaagtttctctaattctatttttcaatattcaattctcaatttttaatttagaatattatggactatatatttctacaaaattattggtggttcctagtatcgttactgggtgctttgttggtgttcctgctctttgtgcagggtggcaactctttgctgttcacgctgggacgcaatgacgaagaacgtgccttgctggtaaactccacaggacgcaagtgggagtttacttttactacccttgtcactttcggcggcgccttcttcgcttctttcccgctgttctacagtaccagctttggcggtgcttactggttgtggatgattgttcttttcagtttcgtattgcaagctgtttcatacgagttccagtccaagctgggcaatctgctgggcaaacatacttaccaatggtttctggttataaatggtattgtaggacctctattgctaggaggagctgtggctactttctttaccggctccaatttcctggttaataaaggaaacatgggtaatgagctgatgcctgtcatcagcagttgggcaaacggatggcacggactggatgcgctgaccaatccttggaatctggtcttgggatttgccgtattcttcctggcccgccttttgggcaatctttattttatcaataacatccgggataaagacttaatcccccgctgccgccgtcagcttataacagatgctattcctttccttattctatttctggcatttgttatccgtactttattggctgatggtttcgctgtaaatcccgagacaaaagaagtttatatggaaccttacaagtatttcatcaatctgatggatatgcctctattgctggtattgttcctatcaggcgttgtcggagtactttggggtatcggaagggctgtcttcagcaagactgcgaccaatggtatctggtttaccggaataggagttgtattgactgtattagctttattgctttgtgcgggatataataatacggcttattacccgtccacagccgatctacaaagttcgctgaccttggcaaacagttgctccagcgaatttaccctgcgcaccatggcatacgtttccattctggtacctttcgttctggcctatattatttatgcttggcgtgccatagaccgcaagcccattacagcaaaggaactggaacaagacggacacgcttattaaagagtcttaatggattatagtgaaggcatcctgttttgcaaatagctgtaaacaggatgcctttctatgttaaataacattgtttcaacctataaaatgaagagaatatcttgcaaatttccgaaatatccgtacctttgcattgtgtttttcatagtattagatttaaggttaacaaaggttggagcaaggcgttgctcctttttttatatctataggagacatagcatccatagttgattcatttcccatctagaaagttattttcgtttaaactcttcatctaaaagaaatattatgatacaagtgatgcatacagttgcggattacgtgcatgatgccaaatataagatgccggatagaccccttccttgtttttatcaaggatttctttcaaaatactgcatttgttctcgcccgtcaccagaaaacaggtatgccgggcttctatcaagggacgtcccgtcatgcatatacgcactgttttattataaggattgacggacacctcatacggttccccggcggtaagaagttcctgatggtcggggaaaatggatgatgtatgcccgtcctctcctatccctaataatacaaaatcaaaaacaggcacaccgtccacggtcggaacggtggtcttgactatggaagaatactgtttggcttcttcttcgggagcgccctcacccacaatacgatagtaatgactggcaggaatacctaccttactaaacaacagacgataggccaagccaaagttgctctgatcatcgccaggtggcacacaacgctcgtctacccaatagaaataaatacgggaccaaggggtatatgtggcatattcacgctcccaaacctcaaaaagtgtggcaggagtagtccctccggaaagagcaatggtaaaaggccgttcaagctctttatccatcgcttccaatatatgagttatcaaggtttgcgacgcttgtacaggcgacgcataaaagttatggtcaatcatcttattcactatttattacttagagtttgctgttttaaatttactatccacagatgacgacttacaatttacagtataaattggaatgtgtcagattcttgcacgggtttgtccactcggaatgactgcggttgatcaatacatccgcttctttcggtccccatgttcctgcaggatacccataaagaggagtttcgggatgcttcttccaataatccagaatcttatcaaagtaagtccagctctcgtccacggcatcggaacgggtaaaaagtgtaggatcacccaccagactgtcttccaacaggcgtacatacgcatcccccgtttcctgatcgtgctggtcatagctgaagtccatctccatggttcccatatagaaaccggcaccaggttctttcatggctatgcgctgaagaattccctcgtcgggttgaatacggataatcagttcctcacctttgtaaaaaccttccttcatttggaacatctgcataggagcaggtttgaaatgaaccacaatttcggtcaccttggtaggcatctgctttccggtacggatataaaaaggcactccctgccaacgccagttatccacatacagacacatcgccacgtaggtatctgtacgggaatcaggacgaacattcttttcttcacgataaccgatacggtcatcaccagcaatatattgtccgcggataacattatcacggatatacttatcagtcagcggacgaagggattggtagaccttgatcacctcgttacggaaaccattcttgtcaaacttggccggtggttccatggcagtaatagcaagcaactgcatcaaatggttctgtaccatatcgcgcagagctcccgccccgtcataatatcctccgcgagtacctatacccatattttccaccgcagtgatttctacataatctatatagttacgattccatatcggttcgtaaatagtacttccaaaacgggtcaccataatattctgcaccgtttccttgcccaaaaaatgatcgatgcggtagatatcctcttctttaaaataagcggcatagattttatttagtttctgagcggaagccaggtcgtatccgaaaggcttctcgacaatgatacgctttaatccaggctttttcaacaagcccgcatcatgcagacatttcggaatcaattcataaagcaagggcggagttgccagatagaacaaatagttcccattattctcatattgaggcgaaagctccttcaaacggtcatttaacagaaaataagtggtttcgtcagccgggtccatggactggtaatgaacagtagagagaaaatcgtccaatgtttccatttcctctttagtaagaaaaccgaattttatcagttcttctttcagataggcacgataagtttcgtccgtgtatgcagtacgggcacagccgataatggcaaaatgctcggggaagcgtttcccgttatgtatctttatcaaggcaggcatcagtttgcgccgggttaaatcaccggatgcaccgaagatgaccaaaaataaactatgtggtaaactcatgattctttgttttaaaaatgaatgtataatgctttgtgttgcgacatatcaatagttgtcttcccaatgttcgtggaaaaattccccccgtggactgtccacacgctcgaaggtatgagctccgaaataatcacgcatcgcttgaatcatattagctggggaacggttggtggtcagacccagaaaataattcaacgctgcggaaagtacaggtacgggcaacccttctctcaacatgacaccgatgtatttcttccacgcgggcagggcttccattacttcccgtccgaaatgctcgtccagcaacagatgcgacaatcccggtgcacggtgataggcctcggcaatgtcgttcagaaaagcagaacgaataatgcatccggcgcgccacaacagcgcgatagtggaaagattcaacttccagccatattgctcactggcagtgcacatcagagcaaacccttgcgcatagcttgtcagacgagccgcatataaggtactttccaatccgatcaccgtatcctgataattatataccggatgattctccacatgcatataatgtttggacatcagcacgcgcaagttcttctctgccgacagattacgggcaaaaaccgcctcggcaatcacgtccagtggtgtatttagttgtagggagttaatgacactccagcgacccgttcctttttgtcctgcagcatccagaatgttatcgagcaaataatcgcctccttcttctttatgacgcagaatggccgaagtaatctctatcaggtaactatgcagacgtcctttgtcccattgttcaaaaatatccgccatctgttcattcttcaacgccagcaggtgcttcatggcgaaataagtttcagcaatcagctgcatatccccatattctatgccattatgcaccatttttacatagtggcctgcgccaccgggacctacccactcacaacacggagtaccatcctcagcttttgccgcaatacttttcagcatcggctgaatgactggccatgcctcttgcgcaccaccgggcatgatggacgctccatgcaaagcaccctcctcacctcctgaaatgccgcaacctacaaagtacattcctttatcataaagttcctttacacgacgttccgtatcttcataataagagttgcctccgtcaatgaggatatcacccttttccatcaaaggaaacagcttgcccgtcagttcatcgacagcgggacccgcctgtaccatcaaaaggatgacacgcggagttttcagtgcttcgacaaaatctgtcagttcattactgcctatgatgccttttcctttggcgcggttggctataaagtgttccactacattttcttcttttccaggaacggtacggttccatactacaaccttccatcccttgttggcaagattcagagcaaggttctgccccatcacacctaatccgattaatcctatatctgccttttccataaattattctttttatatttaacaatttgataggttatttgttcaataattctatctttgcaatttgaataataacacattatcatgaagaggttaaaaatcggcttattagcccgaattatcatcgccatcacattgggtataggattcggaaacgttcttcccggcgaattggtcagagtatttgtgactttcaacggaatcttcagcgaatttttgggtttcatcattccgctgattattctcgggctggtcactcctgccattgccgatatcggtaaggaggcaggaaagatgctggtgataacgacattggtagcatacagcgccacgttgttctccggtttcctgtcttatttcaccggagtgacttttttcccttccatgattactccgggagcaccgatagaacaaatcagcgaggcacatgatatttctccattcttcactgtagccatccccccggtgatgaatgtgatgacttccttgattttagccttcacactaggtctgggcatcgcacatctggatagtacagcgctgaaaaacgtatgtaacgatttcaaagaaatcatagtcaaaaccatccagacggtgattctgcccctactgcctatctatatattcggtatattcctgaatatgacccattccggacaggtatataacattctgatggtatttatcaagatcatcggagtcattttcctgcttcacatcttcctattggtttttcaatataccattgcagcgctgtttgtacatcggaatccgttcaaactactgggaaagatgatgcctgcctatttcacagcattgggcacacagtcatcggcagccaccattccggtgactttgcgacagactgtcaagaatggggtcacggaggatatagccggatttgtcattccgctatgtgccacaattcatctgtcgggaagcacgttgaagattgttgcttgcgcactggcactgatgattatgcaaggaatgccctttgatttccccatgtttgcaggattcatctttatgctgggaatcacgatggtagctgcaccgggagtaccgggaggagccatcatggctgcattggggatcctgtcttccatgctgggattcggagaaagtgaacaggctttgatgatagcactttacattgccatggatagtttcggtactgcttgtaatgtgacgggcgatggggctatcgcattgattattgataagtttttcggaaagaaaaatctccggtccatacaataaacaggaaaaatattcccgaatcagataaagtcaggaaactctgtaacccattcatgaaaagttgccaggctgatttatgacgtgtatgataaaaaaggtaacggctttaactctgataaaagaaagacattttcatgataaatagcaggcaggcaacaagttgcctgccgattcttcataacaaacaaaaaaggaaagcatgagctagaatataggcatctgccaaatgaatcccactgacacacgatgggtactgaaattatcctcacccaacgcctttgcacgatcggtatatttataggaacgccccacgtatgccaggaagaagtgcagattgctctccatcggataaaattctatacctcctgcatatccccatgccgtgcgatatttccctttttccacttcatcacttgccttataaacggaagcagtttcatacattccttttgcaaacaagttccactttggggcaaaacgataattcacatgcaacacataggacatatattcggcattaaaagcattgtgtgcctgattatcagttcctacgatgttagttataatccctttacggtctactccttcacgagaatacatccagtcaaaataggcatgccatttagggctgaaattaaattcattacccaaagcgtaataatacatcttttcgcccttcgtttcgttcataacagaggcagaccaacgggttttgaaaacatccaggaaatttccgttccagttcaaggtataaactaacggcagtttggtacgttccaaatccccatacatctcctcggacggtccgttccgactgttcaatacctgaaattgtatctgctgataagaattatagttgtatgccacattcaaaccagtcatgaagttactcatgtgctctatcatgtcactatattcgtaaatatcaatcggattcaaatcaaattctataccaccatacgagacacattgctttccggcaaaaaatgagaacttatttaatttgatgcctactcctgcccaatctatgctggtaggtacattatctatattgccggaaccatcgttaccccgattcagacgctgacggtaacggtaactcaaccaatcattgatatctcccttcatttcgatacggagctgcttcatttcgaatgcgccctgatcaaatccggagtcgttccatttcatattgaaatcaccgtgcatattaagatagagattgaacttgtccgttttcttcttgataccggtgacttcttcaaacagacttttgtcaccggccatgaaatcacttccggaagattgggcatataaagggtaagtgcctgagacagcaagggctgtcaggcatactaacattattcttttcataagtcaaagttttaggttataatgtattctctttttcttttatgcgcgcaaaagaaaaagagataaaaagaaaaagtgccggatggactagtatacgttgaagtattcctgaatcttcttccagtcttttgttttagttaatgccaacatcaacaacacacgcgctttctgaggattcaactcttgtgaagccacgaattgatatttattatcatccacctcggcatccaatgtggtcggtccggtaggaacacggctggaacgcactaccaaaataccttgctgacgggccttttccaacatcggaaacaaattctgatgaatgttgccattccccacaccggcatgaataataccttggtaaccattattcaggaaagggatcataacatcagcctctacattggaataactgtaaacgatacctactttcggcagcttgtcaaggtgggccacatcaaaatcggaaccggtggtatggcgtttcaaagattccatattataaaaaaccttaccattcaatacatatcccaacgcaccggagttaggagactggaaagtttgtacatccactgtattggtcttcatggctccgtgggctcccaaaatcaaaccgttcatggcaattacgacacctttaccccgtgattccctggcggcggcagtaactactgcattatacaagttcaacggtccgtccgcactcatggccgtagaggggcgcatggctcctaccaatacaacaggcttgtcactcttcacagtcaagttcaggaaaaaggcggtttcttccatcgtgtcagtcccgtgagtaatcacgataccgtccacatctccacggctgaaaagctcgttgatacgcttggccaacgtcagccatacggcatcattcatgtcctgagaaccgatttttacaatctgttccccggtcacattggctattttgttcacttcgggaaccgcttccagcaatgtgctgatagccacctgcccggcagtataatttgttttagtagccgaagcgcctgttccggcaatagtccctcctgtagccaatatgtggatattaggcttttgggcgacagcagccaatgtggtacataccagcattgccgccataaggctgagttttcttaatccgttcataatcttttcaagtttaggttttattactataataaatatttggaaattttgttcacacaaagaagaagatgtgccgatgatatatatgtatacatcgaatcattataaatgttacaggcagaagatcactcatcttcaagtccgactacacctaccccctttcctttctagaacacctgtaccagcagcagacctatcacaatagaaacaatggtggccaccatcccaggcatcatgaacgaatgattcagaatccattttccaatgcctgttgttcctgtacggtcaaaatttatagctgccactactgtaggataattaggaataaagaaatatccgttgacagcagggaacaaagcaatcaacatcatcggagaaatacccagtgctattcctaacggcacaatggcacgcaccgtagcagcctggctataaagcaaaatggacatgacaaacaatgccagaccgaacaaccagggcatttggcgcacaatcccctcaatagagcctgtcagttccgtaatgtttccattaatgaaggtatctcccatccatgcaataccaaatatagcgattaccgcctgcatcccggcaggaaacacactgccttgtgtagctttaattccatccgtacgtgaaatgagaagaataacagccgccgcacacaacatcaaaatctcaataatagccggcatatccaaagccgtaccattgaacacaggacgcatggcaggaatagaaccgaacaacactatcaacagcgtggcggcaataaaaattatcaccgagatacgggcatgaaacatattcttcacatcgttcagctccacatgttttgtatcaatcatcccggcttccaagcggcgcaagtattcgggatcttccaacaactctttacccaccttctttgaaaggaaagctcccaccagcacaccgattaatgtagcgggaatagtaatcttcagaatatcaaacagagtgatgtcaaatcctgtcagcaatcccagcaacgctacggtagcggcagagatagggctggcagtaatagcctgttgcgaggcgataacggcaatgcctaaaggacgctcaggacgaattttagtttccgtagccacctcggctatgacaggaagcacagagtaggccacatgccccgtacctgcgacaaaagtaaacagataagtaaccaacggactcaggatagtcacttgtgaagggttacgacgcaacaaccgttctgctaatttcaccatatagtccagtccgccggcagcctgcatacaagaggcggcagagataacggcgacaatcatcaacatcacatcaatagggggagcggtaggttgaagtccgaaaacaaaggtcaatatggcaaggcctacacctcccatcactcccagtccgatacctcccagacgggcacctacaataatagcgacaagtacaaatagcagttgtaataacatgttttttatccgtttataaatatacaattttaattctgagaacaaagatagaccatttctgttctacaaaccttaaaatttctaagaatttttccttttttcactactttctccctaaaacattcaataaaagttagttgttttgtataataaacaatttgtcaatgtgctaatcggctgtattatgtcccacatagttattggtacattagcaaatagacaaattattaaattattacatatgaacagaatttgcaatctttttggaataaagtatcccatcatacagggaggaatggtatggtgtagcggttggcgactggcctccgcagtaagtaacgccgaaggactgggactgataggagcaggctccatgcatcccgagaccttacgcgaacacatacagaaatgcaaagcggcgacagacaaaccttttggagtaaacattccgctgatgtatcccgaaatagacatccttatcaatatggtaatagaagagggtgtgaaaatcgtcttcacctctgccggaaatccaaagacctggacagaacacctgcatgagcatggaatcattgtggcccatgtagtggcaagcaccaagtttgccgccaaatgtgaagaagcaggtgtagacgccatcgtagccgaaggattcgaagcaggaggacataacggacgggaggaaacgaccaccctatgtcttattccagccgtcagacagatcaccactgtgccgttgatagctgccggaggtatcggatcgggagaaagcatactggctgctatggcattgggggccgacggggtgcaaataggcacgcgctttgcattaaccgacgagagttctgctcatttcacattcaaagaccggtgtctgcgactgaatgaaggagatacccaactgacattgaaacagctctctcccgtccggttggtcaagaatgatttcttcaaacaagtggaagaagcggaaagccgtggcgcaacaacggatgaactacgcactttgttaggaaaaggacgtgccaaaaagggaatctttgaaggagatttattcgaaggtgaactggaaataggacaagtcgcatcatgcatacataaattacagacggtagacgaagtgatgaaagaactggtggaagatttcaatgccgcattaaacagggtcaatgagctgaaaagatttatctgataaggagaacgatgaaacgattaataaaccggagagtgaatcaaaaccaaaatgaacattctaaaggttacagattgtaaccgacaaatacagaaaagccgtatcattactcaaaagtgatacggccttcttattgtcaatgaagaatgtcaagtttcagatgaaaaattcttttctataaagttgagttttataaaattaagttattctacttacaccttctcttattaagcagattagcactcaggaatcccaccaaaaatatcagcaacgtcccgaacacgatagccagattggcatgtacaaagggggatatcacaatccaacaaaccagaattactccacaaacgactcccagtaccgcatcaaaattacgtgccttcctcgaaatataccccaatagaaacagtcccaacatgcctccgctgaaaatagacgccaacgcccaccaggcatccagcgcactttgcacactcataaaggcaaaagccaccagaatccctgccactcccactcctacactggagagtttcagcaccaacatccgctccctgtttccggcatgtttgcggaaccgctgataataatccgtcagaatgatggtagacgaactagtgacactggtcgcaatggtactcatacctgcggcaaagatagaagcaatcagcaggcctgtcaaccccaccggcaactcattgactataaaaaacggaaagacataatccgcccccaccccgtcgggcaagatccccggatgcactttatagaacgcatacagcccggttcctatcataaagaaaacggccgaaacgggaataaacaaatatcctccgaacaaggccgaaaatttagcctccttctcattcttcgccgtatgataacgttgcacataactctggtctataccatagttctgcaaattagtaaatataccataaatcagacacacccaaaaagtggactcacttaaactgcttccaaagcttcccaagctgaatttaccatcttccatggcgatggagaaagtctgcaccggacctccgggcatatcaaaaagcaaaataaacatacataccaacgcacctccgatcagaataattccctgtatggcctctgtccaaatgacagccttcatgccacccaacatggaataaagcacaatagccacactggttacaacaataatggtctggatatgccatcccaacaatacattcatgggcaacgccaacaaatacagaatagaccctgtacgtgctatctgggtgagcagatagcaggacgaagcatatatacgtgcccaagggccgaaacggttttccaaaaagctataagccgatatgctgtcctgactccggtaaaaaggcacaaagtaacgagccgcaaaataagaggcgataggaatagaaagactgaatacaaatgcattccaatctcccgaaaaggcctttcccggatatcccagataactgatactgctgacatacgtggcgaagatggacatccccaccacccagccgggcaaacttcttccggcagaagtgaactcctcggaggtacctttcttcttaaagaaagaacaaccgaaggccacgactccgccggtaaacaacaaaaagacgattatatcaatgatatgcatacagaccgagcatttaaggtttcaactccggacaaaaagggagtgcctccaacgccttgcgtatcttctcgcgttccggaacattgaagcgatggaaaggagccgcaacaaaatcatcacaaacgcccaataaagacaacgcgcatttcaatcctttcaaataactggagccatgctgccccacggtataaatactgctactgatttgcatcaccaagggttgcagccgacttacggtttccatgtcacgcgctaccgcagcatgataaagatctacatataattccgggaacatattggcacctccgttgatccccccatgtccacccagcaacacacactctgccgtaatttcctccggtcccaccaacatggcgaaatcctgtctgtccttcatggcatacatcacggactggaaataaacggcattagccgaactatccttgaatcccaccacctgaggattacgggcaatgcgttgaatagtagccggagcaaaattcactttcgtgtgcgacggcatattgtacaagaagataggtaacggcaactgaggaatcaggtcctcataaaattcggccagttcaggctgtcccggagcaaagtagtaagggggagcggaaactacggctgaagcaccacactcggcccctacatgtgccagatgaatactttctacaattgatgtatcggaaatacaaaccagaaccggaagtcttccggcattgatacggcaagtttcctttatcatttcatggcgaagccggtaactgatactctgcgcttctccggtggtacccagtataaataatccgtgcacccctccttttatcaatcgttctatcaacctttccaaaccgtcaatatccagtttgtcattatccagtaacggagtcactaaaggaggaataatgcctgtcataggcttttttaatgtgttttccatgattcgttttcttttaaaaatttcaatgctatatttatgaaacgaacagtaggattatttgtactcagcccaacatcccggcttgtccggaaagcgacagggcactatcgtttaacctgttgtcttccgtctgcccggaacgtacctttagaaaaagaacttttaattccgcttcaagaaaagaaagttagttatacatgcgggcaactcttcctgataatgtgtcaccataatcatggtcttgtccttacgacgacagaaagtttctatcacatctttcaccaaccggcggttgtacaagtccaacccatgcaaaggctcatccaaaataagcaactcaggatccttcacaaaagcacgggccaacaacaccagacgctgctcgccactggacaactgcaagaaattccggtctttcaaatctgcaataccaaaaatatccatccaccattcacaagccgccatctgctcgggacgcggacgtttgtacaaccccacagaatcatgtagtccgcttgccacaatatctatggcaggaaggttcttcagataagcgcgatgcatctcaggactgacatatcctatatgcttctttatctcccaaatactttctccggaaccgcgttttctgccgaacaaggtaatatcacaagcatagctctgcggattatccgcacagaccaaactcaacaacgtagactttcctgaaccgttctctccactcaaagcccatttctcgccacatttcactgtccagtccaaatctttcaaaatggtacgctcgccataacggatgcttaccttgttcaaatcgactacgtgctcggtgtgatacaaatcaccgccgtaaggcaaattcagaatccgtgcctccttttcttcggaaagtatccgttccggtatcggcttacggaccgccaaatattcctgcaaagttatctttttaccacacaccctgtcttccacaggaataacatgagtaataaaagcaggaatatcatcggacttagacaagataaggattacctgcaaatgggttactttagtcagttcgcccaacaatgtatgaagcaggtctctcgtcttcgcatccagtccgataaagggattatccataatcagtacacgcggattactcagcaaagtctttgtcagttgaaacttacgtaactcaccactggaaagcagaataatatgtttatccagcatcctctctatgccaaacagttcatacaaagcctttttcagacctgaatcggtcgcttcgggcaacaaatcacgtaccagtggggtttcatccaaatcatgggcattccatcgttgctgataatagtaatttccatcggaatctccatatgaatcacggaaagcaatatactttatattctcgtatgccatcttcgaaggagaaggagagaaatcatacttcacttcgttcatcaacaacggccaccggcctgtaatcgtatctaccaatatactttttcctgccccgtttcttcccacaacagctatatgttctccggcggcaagtgtcatattcaccggttccttcatccggtacagcggatggcgggtcacaccattttctatcgcaataatattctgcattacaaatctcttttttatccaacaggatgcaaaggtaacaaaataatataaaaatgagataatatattatcatcttgttacatcaatcatccactttaattatatatgataccaattatacaacactgaataaccaacaaaatattacctaaactatatgttccataacagaatataggctcaaatttattaagcatcaacaagatatatatttgcactaaattaagacaaaaggaaataataatagaataaattatagacaaaatggtaacaacaatcaagttcacaaagatgcagggagcaggtaatgactatatatacgtaaacaccctaaagcacctcatgtcctaaaactgcatacggagaacgagctggtagaagaagtaacagtggacatggatcttcccctgcttgccaactccagacaaataaataccccggacggcaaaatgttggcaaaaacaatcacagtagatggaaaagaatacaaaagaacatttgtttgtatgtgaaatccacatttagtggttttcatagatgatataaaagatgtaaatttgccggcaataggtccgaaactggagaatcatccgcttttccctgaacgaaccaatgtagaattcgttgaagtattatcacataacaagcacaagccattacaagaaaaacaaatacatacgagatataacaaactcactattatgaattaaaaaggtaaaaagcaatgaaaaagagttctagaaaaacaacatttctgtcggccttggcaatagctgttccggcaatgggcatggcgcaggacaaagtggaagccagcgtaggagccgatctcgtaagcggatacatctggcgtggtcaggatttagggggtgtcagtatccaacccacgttgtcagtttcttacaaagggttctcattgtctgcatggggaacagcaggtatcgaaaaagaagatacaaaagagattgacctcacattaggctacgccacaggaggtttcagtatctccgtcacagattactggttcaatggaggaccggggtattttcattacggctcacacaataccaaccataccttcgaggcacaaataggttatgacttcggaccgctggccttgaactggtataccaatttcgccggaaccgacggagtgaataacggaggaaacagagcccattcgtcctatatctcggctaccgtacctttcacactggcagggctggaatggacagcggaaataggagcgactccgtggagcacagacttttacaactattccgaagtccctgtatgcaacggttccaacggtttcaccgtatgcgacatcagcctgggagccgccaaggagataaaaatcactgattcattctccgttccagcttttgcaaaagccaccgtaaacccacgcactgaaggggcttatttcgttttcgggctaagtttttaatcataaagagcataaccagacaaggataacaacaaagtattagttttttagaaggtaaaaagattacattatatacaaaatacaaatacaacaataaaaaaattgaagttattatctgtaagacccaattcgaggacgtaaaagaagcattgctcgaagccaaaatcgaatggttttcctattacaatgtaaaaggcattggcaaaacatgtcaaggacgcatttgaatgccgtccgcatccgtacagaagagcgcggatatatcgccttgtacaatgcagaacaggagaactaactcattacacggccaagactactccacaaagtaaaaatcatactataacttaagcggaaaattatggatacaactaacaaaaagaggtcgtcagatgtagaacaacctctttttatcaggtaaacacatcataaacaagaaagatgaattacaagcaaggtaccttcacaaatgctgtatccgggaaatgcttctctatataacgacaaatataagtttctgtatctgcttgaatgattttatcctctccttcgggaaacagattgtacatcactgtatgaagctttatccctctccgttctatagcctcaaaactcaataatgtatggttgatacttcccaatcgtcccgaagtaacaaaaactaagggataacccgattcctgaacatagtctatagtcagattatcttctgtcaacggcaccatcagccccccggctccttctactaaaacagcatcatagcgctcactcagcacctccgtggcatgctttattttatcaaaatcaatggcgcggttatctattcgtgaagccaaatggggagaagccggataagaaaatatttcaggtttggtaagtccctgctcatcctcaggcaaatactccatccccatcagacgacgatgcaactcaatatcctccgaataaccttccggatttccagtctgtatgaatttttgagtaatagtacgacatccttgtttgttccaaagatgtgccagataggccgtggcataacttttgccaatatctgtatcaataccacttacgaaaaatacattctgtttcatgattctttttatttctattgtcttttctttgcaataatataaataggatgataagtcaaagtcaccgaacgaccatcactgaacaaacgggcatacttgtcacagaaatcctgcaaatcccttttagtccacgcttgttgcctgacagcagccaccccggtgtgtttcaagtgataaagcacttcgagcggagtaccgaaagtcagacagatacgttcctcatgagccttcacgatctcatagtgtatgcgcagcgcttcttctaattcctctaaagaacgatagtgaagaccgctgccggtaaccgatgcaacttctttcagattatccctgccgaacgtagtaaaagcaaaatatcctttctgcttcaacaaagtattacaacgttcaaaaaacagctcgggagaaacaaaccactgtaatgccgagcatgatacaatcaaatcctgtccttttggaaaaggaagggactcggcatcccctgccagaaaggtagcctgcccgcttcccaacaaatcggtgaaacaagaactcatctcctgacaaatatcattcaacaccagtttttcaggatggagggtttccatcaacctacgggtaagaaagcccgtcccgctaccaatttccaatatccggccgcacggacggggcaaataatgatttagcatatcactcatgcggtatgctatctgcttttgtgccaccgcctcacggttataactctctacagcgcgggaaaagcgacgggttatcaattgcttattaatcatatgtttttgttttaaataacagacgggcatagcaaatctctcattatttcttctgaataatgaggaatatcatactctgccacttccgtcccggtccatgcatttctttggttgaccgccgtaaaaatcaaatcattcttgcctataacagcccgttcccatgcaaaactgggaacagcgcaagattttacctgttctccaatcctccgaagctcttcttgcagttcctctaccgcacgttgcggacgtttcgacaagaatgtttccagattctcctttttcaaacacatcctgcggataaacttttccaacgtaccctcattcaagccttccagtgttccttcaaaaacttgctgcggaatacctttcaaatcatcgacaggagttaccgtgccattcaaagcaacacgctcacaaataggcaagtccatatcctgcaataccatagacgcggcccatactcccatagaccaggctatcaggcgaatctcctgataaccctgcaacaacgtgaaatcaaaatccagcgaacgataatcataacaaaccaacagatcgctattttcggggcaataatccatgaaaggacattcatccattccccaaccggcaaaaaaaagtgtcaatcggggaagatgcttttgttgtataaaataatgtttcatatcaattctatcagactttttatttcttcttcagtaatatccgctgtcaacgaaaaacggatacgcgatgttccttcgggcacagtgggaggacgcaccggcaacgcataaaaacctttacgctgcaagaaatcggcctttaacaccgtatcaccgctatcgcctatcgtcattggcagaatatggctggtagaaggacaagcgtagcctttctttaccaacgcgtctttcaaaagagaggatattctcttcaacctttccctccggaagctgaaactgtccaaatgctccaggataaagaatgtccatagcaagttgacaggaggaagagccgttgtaaatatgaatgtacgcattttattgatcaaataatcacggatggtcttcgaacaaacaatatagcctcctactgaggccaacgctttaccaaaagttccacataaaaaatcgatgtcagccacacaatcctgttcttccgcacaccccaggccatgtatcccccgcacccctacagcatgcgcttcatccacatacagcaatacattatcatattgttgcttcaaagtgaccaaacggcggagatcggcctcatcaccgtccatactgaaaatactttcggttacaataattattctatcatacccggcatgattggaaaccagcaactgttccaattggtcatatcggttatgccggtaccggatacacttggccgccgataaacgaatgccgtcaataatgctggcatgtaccagtttatcggcaagaatcaatgtacgagcatcgctcactgcaggaagaataccggcattcatgtgataaccactattaaaaaccaacgcgctttccttccgaaacagtcgggcaagcaaatcctctatctgaacatagatattaaaatttcctgtcagcagccgagaggatgaagaggaaggaagaaaagtgtcgggagtaagactttgcaagaattccgtacgtaatggcaggtaagcagccaatcccagataatcgttggatgaaaggttaagcatcacttttccattcacctccacctctcttccccaatggcggataacaggcaacttacgaagattacttttattttcaagcagggctaattccctttcccagtctgttaatgaattcattttttctatttttcccaatactatcacttattcttttaattctcctactatctttaccagtgaatgcgtcaatttgctcaattcttccggctgaattataaaaggcggcatgatatacaccagttttccaaaaggacgtacccatactccttcttcgacaaaacgacgttgcatgaaagccatatctaccggtttcttcacttcaataaccccgatagctcccaatacacgcacatcagccacctgcggcaataaagcagcaggagccagctccctcttcaattgtgattcaatagcctttaccttttcctcccaactatatgaaagcaacaattccacggatgctttcgctacggcacaagccaacggatttcccataaaagtaggaccgtgcataaagactcccggataaccgccggaaatggtatcagccacctcatcactggcaaggacagcagagaaagtcatgtatccaccggtcagtgccttacctatgcacatgatatcgggctggacacctgcatgctcccaagcaaacagtttccctgttcttccgaaacctgtcgctatctcatcaaagattaacaacagacgatattgcctgcaaagtttctctacctggcgcaaaaactcaggatgataaaaacgcattccgcccgccccttgtacaataggttccaaaatcaatgcagccatttcttcatgatgctgttccaatatttccttcaagggttctatatcctcttcataccagattccgccaaagcgcgaccggggagcaggaacaaaataacgcacaggcaatgtagggccaaaaatatgatgcataccggtcaccggatcacaaacggacatggcattccacgtatctccatgatatccggactgaatagttacaaaattgtttttcttttccttcccttgcgcataccaatattgcacggccattttcagtgccacttctaccgcaaccgaaccggaatcagcataaaatattttctgcatacggggaggaacaatcttcagcaacaacttgcctaattcgatggccggatcgtgtgtcagtccgccgaacatgacatggctcatacggtctatctgttccttgagcgcttggttcaataccggatgattgtatccatgtaccatgcaccaccacgaagacatcccttctatcaaacatcttccgtcctccaattctatatatactccatccgcccgtcttaccttataagtggacagcggatgagtagtcgatgtataaggatgccataaatgctccctgtcaaaattttccatatattatttccttattgttataataactttataatgtatcaaagcgaatacccggcctcttctatcaatattttatcttctgatactttggaacctaatgtagtcagcaaatctcccacaatggcagaattaataccgatatacaatgctttctttacagcttccacactcatctgtgaacgccctccggcaaaacgaagaaaggctgtgggattgataaaacggaataaagcgatggttgtcagaatctccgcctctgcaagacgatccattttttccaatggagtgccgggtataggctgtaacaggtttataggaatagactgtacttccaattccctcagtgtaaaagcaaactcaatacgctgttccattgtttcgcccatgccgatgattcctccgctacatacatccatccccaccctgcgtgctgcctgcaacgtttctattttctgttcttgtgtatgagtagaacatagagatgaaaaataagagggagccgtttccagattacaatgataacgggtgatgcctgccttaaacagccgttccaattccgcttcatccagcaatcctaaagaagcgcataactgaatatgcgaatgcgcacgcatgtactctgttgtctcacatagccggtccatgttacggctacccggtttcctgccgctggtcaccaaagaaaaacgggatactccctgcgcttcgttatacaaagcatggcgcagacattcttccttcccaaccaaatcataaacatccgcttttgttttataatgtgcagactgtgcgcaccatttacaattctcaggacatttaccggatttagcattgataatggaacacatatcgaatttccgagaagccaggacccgtgttatctcatgagccgcatcatacaaatcctgtttctctgcctggcaggacagccaacgggcttcttctacggtaatcttctcaccgcccaacactttgtttcttattgcattcagcatcatatacagttcatattaagacaaaaaaagccgaaaagatgcatggcacatctttccggcaaacaaatatttatttaaataaaaaagacaaatcacgtcagccacctgtggttgaggcagttggatccgaaacatttgcaacatggattcaacaggggccattccttcttcatattcctctccagcatcctctttccgtgcggaagagcaaacagagaatgccgtgcaaacatttgcctgtttacccaacgatacatcggcaatctcctttttcagattaccaatagttacatatttgcccaagctataaaacatagcgtacttcttccggctccaatagcggaaacgtatcgtatgtttattctggcacaattgtttcatgttttttcgtatctgagattggcaaaggtaaataaaatattcaatgcagcaaacttttatatagaaaaacaccgttccgcctcttacaaccttaaaaccagttttccgaaagcacaacggtgaattcttaagtcctttatattatatttctgttattcttctttcttcgaagcagctttcttggcaaccggcttctttgccgttgctttcttggccgcaggttctttctttacggcaggagcctttttgccttcagctttctccagtttagcctgcaatctctccacttccttgttcaaagccaccaattcctcgccctgattcttaatggtagtaagcaacgaatttaattcttcgttatccatatctaccggatacaacgaattgacacgacttataaaatcacccaaaatgttcatatagttggtgaaagcatcatacggagaatcataaataccacgattcaaccaaataccggtattcttagtggtcatgaagcggaaattattacttgcctgcaaataatcccaatcctgcttaatacggcgatcatcgcacaaatgaacacgttctgccacactataaagtttattgaaagcctcacgctgcatcacattgcctaaccacggactgatatcgcgttcctcgtctatccatgacataggataaggaacatccacctgatccacagatttcagtttggtaatgatatcggtcggagtagagaaagtaacccctctttcttttgcgcagacaggcagtgctttcataaattccaaaatattggaagacaatggctgggcgatacccaaagcagaaagttccatgaaaatattgataacctgctcctcctccggcaaagctgcaatccaatctatatatttgtcggcaaacaacggatattcattccattcggaattagagaaacgcaggctgatgtcatcagacaatttgaaatcgcgaagcaataacttcaagttcggattcatggcacaatgatacaggtagtgcgggctcttccaacccaaaatatgtttcgcgccttcagtcaacatacctttaaagcccatatcggctatcgtagcgccaatatcattcgaataaatcaagctggagttacggaataccttcggctccttgccaaatatttgtttaatcttggtacgcatacgttccacttcttcgcggaaacaatcttcattagccaatgaggaaagaccgtgagaataaggttcgcacaagaattcgcaacatccggtctcattcaactgatgcaacaactcgattacaccgggcgcatgcacttccaactgttccagcgccacacccgagatagacaaagccaccttgaaagtatcaccgtgattctttgccatttcaatcaacgcactcagcgcaggaatatacgagcgttcggctatatcactgatgccgcgctcattttcataatcatcataataataatggtcacggcctatatcaaaacagcgatagcgtttcagatggataatttgatgtatttcaaaataaagacatattgttttcatatcctagttattgttttattatttaccatagttttttaacacctgctcatagagggcacggattctcaagccgactttctcccatgtaatgccatccacctctttctttccttcttcctgcagatattggaaaagagaaggattcgtacaaatagaatagatggcatcggccatagcgttgatatcccaataatctgtcttgattactttatccaaaatttcaccgcaacccgattgctttgagatgatagaaggagttccgcactgcatagcctctaaaggagcaataccaaaaggttctgacacggaaggcattacgaatacatcactgtttttatatgcttcataaacctgacgcccacgctggaaccccgggaaatgaaaacggtctgcaatacctcgttccgcagccagattgatcatggcgtccagcatgtctcccgatcctgccattacaaaacggatgttacgggtacgcttcaagaccaatgcggcggcttccacaaaatactcgggtcctttctgcatcgtgatacgccccaggaaagtcaccactttttctttcgagtgatcaggacgaggaatgtccagcaaatcttgcgaaagcggataaacggcattgtgcatggcaaaacatttgcgcgggtcttgatgatattggtgaataacagtctgacgggtcagctcggacacacacataatacagtcggcatgatccatgccattcttttccatagcatatactgtaggattcactttaccgcgcgaacggtcaaaatcagtagcatgcacatggatgcacaaaggtttgccacttaccagcttggcatgcacaccagccggataagtcagccagtcgtgcgcatggataatatcaaattcttgctggcgcgcaaccacaccggcaataatagaaaagttattgatctcatcatgaaggtttcccggatagccgccggcaaactccatacaccccagatcattgacgtgcatatatgagaaatcagaatagatatgatcacggaaagcataatactgttccggagtcgaagtcgaaagacgtgactttaagtaatcataatccacatcacgccacacaatgggcacttggttcatgcctataatgttcagaaacttttcttcgtcgccacaaggtttgggcaaacagaaggttgtttccatatcaccttgcagactcagaccttttgttataccgtaagatgctacagcaagaccaccatatattttgggaggaaattcccatccaaacattaatactttcatacaggtccctcctttcaataattgtatttactcaataaatataatactcgtaatatctctgccacattcatagcgaatgatacagctccacgacctttgaaaggcgggttaccatcaaacagttcaggtatagagccaatacaatgagaagtcatttcgtcttcgtagcctatcagctgacgctccacaaatcctatgccactcatcttataaatacgaaggtaagcttcaaaatagaagccagccagccaaggccatgcggtaccttgatgataagcataatcacgctgcatctgaggacctacatagttcgggttgtaaccgccactcttcgggctgagcgaacggagccctttcggggtaagcagttctttggtcacaatgtccaacacccctttcttctgacgggcatcaagcggagaatagtcgaatgctacagtaaatatcatgttcggacgcacactccagtccatcatattgccatccacataatccagtaaataaccatactcattcaagaaagtatccacgaaagcctttcccgtcttttctgccaatacatttaacgtttcagccaaattattgtttccaccttcgcccaacagttcatttgtaaagcgtaaagcattataccacaaagcattaatttctacgatatagcctgtacgaggaatcacaggacgtccgtttgcggtagaattcatccatgtgatagccttttccgttccgttggcatatagcagaccgtttgaatgcaagaaaaggttcggatgattctcccggcgaaggtattccataatgtcctgcaacaatgtaccatatttctcacggcattggtcacgcgacaccatcttggcatattgctggatacaccacaccgcccaaagcaaaacatcaggatgctccatttcgtacactttaacatcatcaggctcatcattaataaagtcatgaattgccttgcgggccgtttccatcaccatttcaaacttagccacttcatcaatcgccaatgtcagtcccggcagggaaataaacatatcgcgcgcacggcatttaaaccacggatatcctgccagaatataaaactcatctccctgtttatttaagaactgatgggcagcatttatcagacagtgctggaaattatcacgcggagtacgttcttccacctcctcttcaaaggttctctttaatgtacgggtaccggcctcggaaacacctcctgaaaagacaatgctttcacctttctttatgtccacttcaaaataacccggaacatacaaatcttcattaaaatcatatcctctctcctgctctttgggatactcaattccccgataccaatccggctgatagtggaattcgttcttcttgttcaattgcatatataattcgggatagcccggatacatgcatgtcttgatcccattgtccacctcctgatagtcacggctggcttgtgcgttctcatgagtatactgacggacgctgcggaaagccagaaacggacgcaaacgcaacgtagtggccgaatgtgcctccagcaaagtataacggattaaaattctattttcatgatgaacgaaaagcttttccttcttcagaatcacaccacctacccggtatatagtggtaggaactttctcacactcgaattcccggatatacttgtgtcccctggggctgtaattgtcaccctgatacttatgaagccccaggttaaattcagcgccgtgttgtatcactgtttcatccaacgacgataacaatacatggttttcatcatccagctcaggcaccggaatgacaagcaatccatgatattttctcgtattgcaatcaacaatggttgtacaatggtaagcccctgaacggtttgtgcggagaatttctttcggtaatgattccccgaggttcgtcataagagtcttgtcaaatcgtaagtaactcatagttgttattttaaggttataaatcaaatttccatatcaatttgtgtcacatattatttttgtatgcaacgctcaaaattagtaattaaatggataaagcaaaattaaatagcaaaatatttttcatttttcgctcaaatatccgtagtattgcacagaaatcagcataattatgacaaaatgaaacttgaaattcaaaaaattctattggcttttgctcttccgttattacttcttttcattctgtacaccctgcgtacaatggaaagtgtcatgaattgggattttatcacctggggcatatatcccaaagaaaccaaaggaataatggggattctcacttctccgttgatacacgccgattgggaacatttatttgcgaacactttccctcttcttttttattatggtgtctgctctacttttatcgtgatttgggcattggtatactttttttcatctggatagtcagtggaatacttacatttataataggcaagcctggatggcatataggtgccagcagtataatttattcactcgccttctttctgttcttcagcggcattctccgcaaacacgttcctttagtagccctgtcattgcttgtcacctttctatatggcagcctggtatggaacatgttcccgcagttcgcttcctccaccacttcttgggagggacacttggggggcgcagcggccggaatagccgcagctatattgttcagacacaaaggccctcaacaaccggaacttttcattgacgaggaagaagaagataacaggagttatccggaagacgaagaagtcattacaaatccggaccaagaaaagaaagaatgactaaaccaatctttccgcctcatgaagtccaaaggaccggaagggatgaaaaaagcaataacccgctaacggaattaaacgaatgctcatatcctccctattgtataagccttttctatcttcagattaaacctttttatacggatatattctatctccatagcctttggagttatctcccaaggctatggagttaactccaaagcttatggagataactccaaaggcttgcggagataaaacaggcaggaagaaaacccttaaccatacgtcaggaaaggtttaggaatccgaataaaatattttaaggatgaatctgattacaaggccacactccctacagaaaaaagtctccctacgcccttcttttaaaaagaaaaactataaaaccttgtttcagggaagcacacctttggaacaacaaaaggtccggacttggaaaagcccggacctttattttatatccatcaatacaagatattaatacacctctacctttgcagcagcagccttgcacttgtcacgcaaagcgtccaagtcactgccattaggagcataacaaaccacaactcccatacggcggttcaattttgtataaggtttaccaaaaatacggagataagtatttgtctccttacaaacttcctcttcaccacgataacggggagcttccttgctggcaattggagaaagaatcactgcactggcccctatgcgttcttgtgtaatttcagggataggaagtcctaacaccgcacgcagatgcaactcaaactcatttaaattctgagtacctgccaaagtcaccattccggtatcatgcggacggggagaaagttcggagaaataaactccgttttcatgactcaagaaaaattcaactccccagattcccgcaccggtcaaagccgccgtcactttatcggccatacgctgtgcctccttcaaatgttcgggatcaatgtgcgccggctggaaactttccctataatctccccctttctgtacatgtccgataggcggacagaacaaagttggaccgtttttctgagtgacggtgagcaaagtaatctcactatcgaactgaataaattcctcaatgatcaattctttaatatctccacgactgccttcacatccataatgccatgcctgttccaactcatccgcgctcttgaccaaagactggcctttgccggatgaagacatcaaaggtttcaccacacagggaaagccaatctcttttgcggcctcctgcaattcttccaaagacttggcatagaaatacttggctgtctttaatcctaattccttagctgccaaatcacgaatggccttgcgattcatcgtgaaattcactgcacgggcactcggcactacttgaataccttcctgttccaaatgatacagacgttcggtacggatagcttcaatttcaggcacaattatatccggcttgtgtttggctaccacagcatccaacgcatcaccgtcaagcatactgaacacttcaaattcatcagccacctgcatggccggagcacctgcataagagtcgcaagcaataacatactgccctttacgttttgccgcaatgacgaattccttacctaattcgccagaacccagcaataaaatcttcttagtcatagtatttatatatgtttgatattccttacaaaaaacggagagttgagaacaagacacctcttgattcccaactttccatctgcaaagatagtgtattttataaactatacgatatcattgaagcaatatttggatcattcagtacaaagaaaacacccactcccaacgcgatgagccacaatacgataaatataattttggttacaatggacatgggttgccaacctccaaaatgacgcatcagcatgtgtatcagtcctataataggaataccgataaccagaatacctgctacggacatagcgacagtcacccccggagagctacccaccgtagcccaattaaccgcaggcagcatctcataaagcacagccggcaatgcagcaatcagtcccgtagccgccatcagcaatgcaaaaaagacaatcaataatacaaacaatacaggcgcacagcaaatagcaatgaaaacaagcaggaacttgataaggaaccctgccacagacacaatcccctcccctatcttttgcaagatactcctaggacggtctgagcgtacataatcattcactttttcaaatccgtctgttacagtcttgcctatattctccacattaatagcagcccccttcatggcgagtttctcgggagcggtacgcgccataggaataataatccacgctatgatataagccaatatcaccccatgaacaaagaaaccaagaaccaatagaatgatacgtacccaagtaacatcccatcccatataagcagccagtccggaagccactccacctagtatcttattgtccggatcacgaaacaagcggcgcatagtggttcctttttgtttttccgaacccgatgcttctccactttcttcatcggaaagatcttcgggtttacccatccgggctatgatttcttccacatcttcaatggtaataacctgtttaccttcattcaaacggtcggtaaacagctcagagatacgtaattctatatcatgtacaatttcttccgctccctcctcacgacagaagtgaatacgcaggttagttaaatagttatccaacaaatggtaagcgtcttcgtctatatgataaacggtacctcctaaatttatggttaaagtctttttcattgtatcctgtttttaattgttttttaaatgattcactgtattcgccagctcctcccaggcagcctccagtccgctaaggaatgtttcaccctgaggagtgagactataatatttacgaggtggtccctgagtggactctacccattcgtatgagagcaggtcatcgtttttcagccgggtaagcagcggataaagcgtcccttctactacaatgagccgggcttctttcaatttttgaatgatatccgaagcatatgacggctctttgtgcaacaacaataaaatgcagtattccagcattcctttgcgcatctgagatcgtacattgtctacattcataatctataatactttgtttggcacaaatatatgtattatacaagtaccttgtattacatagttctactattttgcataaattaatatttaaacaagaaaaagaaaggaatcccctttttttcttgcaaaaagtttatctttgcctctcgttataacactaaaaagatataaagatcatgtttaccataaaaaaggcaacgaccaatgatattcagttgattaacgagatggctcagatcgtgtttccggctacctaccgggaaattctttcaaaagaacaattggattacatgatggactggatgtactctccgaaaaacctgcgtaaacaaatggaagaggaagggcacatctattacatagcttacaaagatggagaagctgccggatatgtttccatacagcccgaaggagaacatttatttcatctgcagaaaatctatgtacttcccctttttcaaggttgccggttgggcaaagcactatttgagcaggccgtcaaagcaattaaagaaatccatcccggaccttgcgaaatgcatttgaatgtaaaccgtaacaataaggctttacaattctaccaacatttgggaatggaaaaagttgcagaaggagatttccatataggcaacggatattatatgaacgattatatcatgggactgaaaatctaaccctatcttacaaaaacaaaatggacgaatatcgtatcaatggattgaccataaaagaaaatttgctgcaactggcagaaaatggaaataaaaagtttaccgaatcgctgcatccgggaatagaaaatgtattgggtatccgcatccctgccctaaggcggttaggagcacaaattgccaaagatgactgggagagttatctacagactgcggatacttattatatggaggaacgtatgctacaaggtatggtaataagtaatctgaaaatgaaagacacgcaagcatatctttcactggttgcccggtttattgccatcatcaacagttggtctgtttgtgacacctttgacttttacggcaaacaacggtttgtggacaagaacaagaaaagggtctggctatttttggaagaccggatgaaatccgacaaagaatatgaaatacgtttcggagtagtaatggcaatggctcattatattgacgaagagtatatagacaacgtattgcaatggatggaccggatcagtcacgaaggatattatgtgaagatggctgtagcatgggctttatccgtatgttatgtcaagtttcctcaaaaaacgatgaactatctgaaggaaaatcatttagatgactttacttacaataaggcactacaaaaaatcatagaatcttatcgggtaagcacggaggacaaagaaatcatccgcagcatgaaaagaaaaaacaaataatgtccatttaccgcaaagaggctttgaatccttccgaaagaaattcaccattcatattcggaaagattcaaaccgctccagcagctattaataatcgggaaaagttattcctcccaaaccaaataagctgaaaccagccaatgattcaatttattgccatctacctgttgtgcctcagggatacttaccttaaaagaatgtttaccggccgacaagtcaccaataacagcctcctcaggcatcacatcgctacccggacaccaattggaacgggacaaatccgaagaagccaaaggttcttcaatctcttttgtcgtataccccttatcacctatatatgcggcaactcgtggtatcagccatactcccgtggccggattaaaacggcggaaagaagcacagtcatcacgccaaggaatgaaattcaacacctccttgccatcaacagacacgatgttccgtttctccacaaactcatctccgccactatgtcctccgtgacctgttacaatatacttcaaacgaacattcttggcagctttcggcatatcaaaatccatcaccacatctttgcgtgagaaaatatccggataagcctgtccgatataatacaccgtattcatcaaaggcttcacacggcgctccggcatcacgtcgctagtgatcttactctccttcacatccaattccatactggccacatacccctcggcagtccatgtatcaatataaattcccacgtatgcctctctctccaatgccggataaagatcggtaatatcctgcacccaagtcacactcttttcccatttcgggatatatacaggacgcctcttgctgctcaaagaatcattatccgaactataataccccacaccgaacggggtcataaaacgcatcagttcaagggtaggcacataatcctgacccggaacaataccaatcattttttcatatttggtactgtctaccgcaggaaacgccctcttgccttcggctatattcatcagattaatcaccgattctttgggaagcacaaaacaagagccagatttatcccaacggtcaccattggaagctacagttactttcagggtaacatccacatcccttttataatcgggcaaggttattttctttaaaatgatacgcccgtttaccagacggatcactccgtcagcattggcaggagtataattagggaaagaatcgggacgaaaacaaacaggggttttgtcgaatacttgaatatgagtatttcccaatgccggtaattctttgtgatttgcagcatcggccggcatcataaaagttgccgccacagccagtggggcaataaaggtcagcaggttcattctttttaattataggttagtaatcaagggtatataaattaatttcacaaaaaactacacgggcctacacaaatcgtccgatctgtataaatccatgtagtctataataaaaaaaggaattattgatgctgttcacgcaacaaatcattcacagtcttcaccgggttaaaggtactcaacggcacttcaacaaaaacagtgttccagtcactcattgcgccgttccacaagcccggaagctccaatgctttcagttctctaccgttctttgatttataagagataaaacctgtagccttatccacatacttcaccaagtcgaatttgtttcctttataatcgcgtaccgcacacaccaaatccaccggattaaagtgagtacccttctcgaacatctctttcttgaccggatcattcatgtcaatctgagaactttccaaaatttgcaatgaaacagtaccatccgcattataagccaggaacgggccgcctcccggttcacccacattcttcaccataccgcatacacgcatcggacggttcaacttcttacgcagataaataaccagatcggcatcttccagatccttgatatccagtttgcggcaacataaagtctgctgtaagaaacgaatgatctcttccagctgcgcatgtgtatatttaccgccatccagtaattccaaatattcaaatacctgcttctgcagagtaaccagtacccccgcaatcagctttttatacgtaacagtatcctctttcaagcgatcgggaaccacattatctatattcttgataaagataacatcggcatccaaatcattcaggttctcaatcagcgcaccgtgcccccccggacggaacaacagcttgcctttatcgcggaaaggtttgttctccatatcggcagcaaccgtatccgtactcggcttctgttcagaaaacgacacatcatattccaccccgtatttctttgcataaacggcaaccttctcttccaccagctttgtgaacaactcacgatgttccgtagaaacggtgaaatgcacattcacttttccggtcttgcctgccgcatacaacgcaccctccaccaaatgttcttccagcggtgtacgcacaccatccgcataccgatggaatttcaacaaccccttcggtaatgccccatagttcaagccggcagcttccagcagattggctactataggtttatactccttcccggccatcaaagcatcaatatcctttcctgtattatccatacaagccgcattcaagtcattgtagaatgcgaagctatgaatatggtcgaaaaatttcttttcgaaatcagtcttcggaatattgtaatcagcccccaggaattcgaacaaattcttgaacatgcggctggcagcaccagaggcgggtacaaacttcacgatggttttctccccttccttatatgtatcccatgcttccaaataatttttcatttcattttcggcgggagccatgattcccttttcaacagaagcggctgcatccaacttcaaaaatgggaaacccttttcaaagcaagccagttgttctgcaatctgctgctcggaaattccttttttcactaataagtctttgtcttcaggtgttaacataagtacatgattttatatggtttaaataaattgttaccttattctttcactattaattgcccaaaaatacaaaaaaatgcgagaacactacctaataaataaagaaaaaaactacctttaccctcgaaaagatttcacgtgttatggaagaaaaagcatttttcacagccaaagagcgtgagcaactgttcgccctctataaacgattgctgcaattatccggcgacaccttgcagaagggtgattgccataagttaaaaatacacctcataaaagcagttgccgaaggtaacctgccacgaaattgtttcggaatgaatcctatcatcaaagatatgcagaccgctgtcatcgtggccgaggaaattgggatgaaacgggcttccatcctagggatcatgctgcacgaatcggtaaagaaccatttatgcaccttagcatctgtacaacaggaatatggagaggatgtagcggggatcatacgcggtcttgtgaaaatcaatgagctatactccaaaagccctaccatagaatcggaaaatttccgcaacctgctgctctcctttgccgaagacatgcgtgttattctgatcatcattgcagaccgcgtgaacctgatgagacagataaaggagactcccaatatagaagcacgcacccaagtagccaacgaagctgcctatctgtacgcaccgctggcacacaagctggggctatacaaactgaaatcggagctggaagacctttccttgaaatatactgaacacgacgtatattatcatataaaggacaaactgaacgaaacgaaaacctcccgtgacaaatacatagccgcctttatcgaaccgatacagcataagctggaagaagcaggattgaagttccacatgaaagggcgtaccaagtccatccattccatctatcagaaaatgaagaaacagaaatgtcccttcgaaggagtgtatgacttgtttgccatccgaatcattctggactctcccgtcgacaaggaaaaacaagaatgctggcaggtatattccattgtgaccgatatgtatatgcccaatcccaaacgtctgcgcgactggctctccgtacccaaaagtaacggatacgaatccttgcataccactgtaatggggcctgaaggcaaatgggtggaagtacagatacgcaccgaacgcatggacgagatagcggaacgtggtctggcagcccactggcgttacaaaggcgtaaaaggagaaagcggtctggatgaatggctgacctccatccgggaaacactggagaacgccgacagtgacctggaagtgatggaccagttcaaactggaattatacgaagacgaagtattcgtattcacccccaaaggtgacttgtacaagatgccgaaaggagcgaccgtactggactttgctttcgccatccacagcaaactggggtccaagtgtatcggagcaaaggtgaacggaaagaacgcacaattaaagcaaacgctgaacagcggtgaccaggtagaagtcatgacttcaaacacccagacacccaaacgcgactggctgaacatcgtcaccacttcgaaggcaagaaccaaaatacgccaggccatcaaagagatagaagcccgccagacagagttcgccaaagagaccatagaacgtaaattcaagaaccgcaagctggaatacgacgaagcagtgatgatgcgcctgataaaaaagctgggatacaaaaccgtaaccgagttctaccaggacatagccaacgagacaagagatgcgaacgacatcatcgaaaaatacctggaactgaagaaaaaggaaacggaaaaccgggaagatattgtctatcgcagcgccgagaatttcagcatgcagacagcacaagatgacaagaccttcaaagaggacgtgctggtcattgatcagaatttgaaaggactggacttcaaattagccaaatgctgtaaccctatctatggcgatgatgtattcgggtttgtaaccatcagcggaggaatcaaaatacaccgtaccgactgccctaacgcacgagaattgcaatcacgttttgcctaccgtatcgtaaaggcgcgttgggctggaaaaagccacggcaaacaataccccatcacgctgcgcatcgtcggtcatgatgatataggaattgtgacaaatatcacctccattatcaataaggaaaacgatatcctgctccgttccatcagcatcgactcgcacgacgggctgttcagcggcatgatgaccgtaatggtagatgacacttcaaagctggaatcattagtaaaaaagataaagacagtaaaaggagtaaaacaggtaaacagaggataaacccatcccaagcttaaaaaaaaatgaatgaactgcataaacgactaaaaagctttacatacgcctggaaaggcgtatgtagttttttaagtaaggaacacaatgcctggatacattgcacagccatcatcgccgtaaccattgcaggcatccggttggaaataacacgcaccgaatggcttgtcatcctcctgtgctttgcaatggtactggctgccgaagcattcaacacagccatagaacgcctggtaaacctggtatccccggactaccatcctgtggccggagacgtaaaggacatagcagcaggagccgtactgatttgcgccatatttgccgccatcatagggttgataatctttgtcccttatttttaaaggtgttaatttaccatttatttcactaacagttaaagaccttttataaaaaaaacagtaatttagccccgataatttttaaacagtggaactaatgaagaaaattttgctttcaacattattgttgattatagggttaaccacatacgcagccgtatggcaatctcaaggagaagcagaaataacctttgagaaaacaatacataatttcggttcatttcccgagtcaagcccgaaagttacctgtgttttcaaattcaaaaattcgggagatggtcccctagtcatccatcaagcgatcgcatcttgcggatgtactgttccccaatatcctaaagagcccatcaaaccgggtgaaagcggacagataacagtgacttataatggagccggcaaatttccgggacatttcaagaaatcaatcactatccgcacaaacgggaaaaatgagatgacacgtctttatatagaaggtgacatgaccccgaaaggcacagctgccgaatagaattctcacatcataagagagaggatgtatcaaaacaaaagaagattcgagtttgatacatcctctttttatatccggaaaacactgccccgcctgcctgtatccaagtaaagacaaaaaaataagaaaaaaagaacatttttccccaataataagccactcttattctgattaaaataacgtactttgcagcaaatttaagagaacaatgacaaacaagctattattctttgtcctgctggccctctgtttcagtggctgtgacatgctggaaacccatccatacgatgtacatattacaggagaaagagaactgaccaacaaaaacatccagttgatagaaaacaaaatgcaaggcaaaaaaacaatccgctttgccatgatcagtgatacccaacgatggtacaactctaccgaagatgttgtaaaagccctcaatgcccgtggtgacatagactttgtcattcacggaggagaccagtccgatttcggcgtcacaaaagaattcatatggatgcgggacatatttaacaaattccagatgccctacgtatgccttttaggcaatcacgactgtctgggtacaggtgaagacgcatacagggccatttatggagatcccaacttcgccttcacagccggaaatgtacgctttatctgcctcaataccaatgcgatggaatatgattattcggaaccggttcccgatttcaactttatagaaaatgaactgaacaacctgtcgcctgaaatagaaaaaacggtattcgcaatgcacgtaaaaccttttgaatttgtattcaacaacaatgtagcaaaaatcttccaactatacgtcaaccagttccccaaagtccagttctgtctttacggccatgaacacaaattcgcagtagatgatctattcaacgacggagttctgtatttccaatgcccctgcatagacaaacgcatctacttattattcaccattaaagaagatggaacctacgattatgaaacagttgaattttaaaaagatatttctgaacctattgtggccactattgccttttacggcacaagcccaagaaaataatacactttactccatcttatccaaagacagcatacttgtctcctctccttccgttcaaaaccaagaggaagatattgtaacccaaatgccaaaccggcaccataaatacgacaagcgcgtacaccgttacaggcgtgcgtgggaagctttgatccccacccacaccaaattacagtacgccggtggaatgggcctgttatcctggggcataggctgggattatggaaaaagaggccaatgggaaaccgatcttcttttgggcttcatcccccgctactcatccaaacatttcaagatgaccatgaccttgaaacagaattatatcccgtggagtatctggctgggcaaagacttctcgctggaaccgctgactaccggaatctatttcaacaccgtattcagcgatgatttctggacaagcgaacctgagcgctatccccgtggatactacggattttccacccgtatccgcacccatatctttctgggacaacgcgtccgtttcgatgtgcccgaaaagtaccggaagttctctaaaagtatcaccgcattctacgaaatcagcacatgcgatttatacgttgtcagtgcgttcaacaacagttatttgaaacccgatgactatctgagactatcatttggattgaaatttcagatattctaatcaaatcatgaggatgtttctctattttttcactatttttgggcatttattatgataaatttcaaaaataataacatagagaaacatgaaacaagaagaagaaaaatcggttggattgcccgataacgcgttccgacctctgaaaccgggggaacaatatcaccccatcatgtcaccaaacaaaaaatatcccgaagtaaacctatggtctgtgctatggggtatcgccatggcggtattattctcggcggccgcagcttacctgggattaaaagtgggacaggtttttgaagccgccatccctatcgccatcatcgccgtaggtgtatcgggagccgccaagcgtaaaaacgcgttaggtgagaatgtcatcatccaatccatcggtgcctgttcgggagttatagtggcaggagccatcttcacattgcccgccctttatatattgcaggacaaataccccgaaatgacagtcaacttctttcagatgtttgtcagctcactgctgggaggtattctgggaatcctgttcctcatccccttccgtaaatatttcgtcagcgacaaacatggcgaatatcccttccccgaagccactgccagtacgcaagtgcttgtttccggcgagaaaggcggaagccaggcaaagccattgctttttgcagggctaataggaggtctgtatgatttcattgtagccacattcggctggtggaatgaaaacttcaccacccgcgtatgcggctggggtgagatggttgccgaaaaagccaaactggtgatgaaaataaacaccggtgcggcagtattaggcttaggctatattgtcggcttgaaatacgcggctatcatttgtgccggttcattagtggtatggctggttattgttccgggtatggccctgttgttcggcgatcaagtgctgaatgcatggaatccggccttgacacaaaccattagcgaaatgtcacccgaacttatattcaaggaatatgccaaaagtatcggtatcggtggtatcgccatggccggtgtgatcggtatcgtgcgctcatggggcattataaagagtgctgtgggactggccgccaaagagatgggcggcaagaaggtggaagcaaacgtcatccgcacgcaaaaagacctttccatgaaagtgatcgccttcggttccatcttcaccatcctgctgatcttactgttcttcttttttgatgtgatgcatggaaatgtattacacagcattgtagccatcctgctcgtagccggcattgcattcctgttcaccaccgtagccgccaacgctatcgccatagtcggcactaacccagtatcgggaatgacactgatgacactgatacttgcctcggtagtaatggttgccgttggactaaaaggcgctaccggcatggttgccgcactggttatgggtggtgtggtttgtacggcactctctatggcaggcgggttcatcacagacttgaaaataggttactggctgggcagtactcctgccaaacaggaaacatggaaattcctcggcacactggtatcggcagcaactgtgggcggcgtcatcatgatcctgaacaagacctacggcttctccaccggcgcattggcagctccgcaggccaacgcgatggcagccgtaatagacccgttgatgaacggtgtaggcgctccctggctgctttacggaataggcgccgtactggcattggtgctgacctacttcaaagtacccgcactggcttttgcgctgggtatgttcattccactggaattgaacctgccgttgctggtaggcggagcggtgaactggtatgtcactacccgcagcaaagacgaggcggtgaacgccgaacgtggcgagaagggaactttgctggcatccggattcatagccggaggcgcattgatgggggttgtcagtgccgccatgcgctttggcggtatcaatctggtcaatgaagaatggctgagcaacccgttgagcgaagtgctgtcaatagtcgcctatatcctcctgatcatatggctggttaaagccagtatgcatatcaagaaaaaataaccctttttcaaataccgtgaaaataaaagctatatgaaacgaatcttactaatgagtttacttgcaatctctaccgcattgtctgcccagaaacctgtagagttggaattatggcccgatggcgcccccaactccaacggcatcaccactcccgagcagaaattagagaacaaccggatttccaatgtcagtgagcctacccttaccatttatccggcagccaaaccgaacggactggctgtcgtggcttgtcccggagggggatacatacgcctggcaatgaatcacgaagggcacgatatggcagactggttcaacgcacaaggcatcacatacgccgtattgaaataccgtatgccaaacggacaccatgatgtaccgttgagcgacgcccatcaggctatccggctgatgagagaacacgccaacgaatggcatattcaaaaagtgggtatcatgggggcctctgcgggcggacatctggccagtacggcagccacccactatacagccggaacgcgtccggattttcagatcctgttttatcccgtcataagcatggatctgtccaactgccataagggctcacgtgacaatcttttagggaaaagcccgtcagaagagctagtgagactttactccaatgaactgcaagtaacaggcgacactcctcccgccttcatcatgcatagcagcgatgacggagctgtacccgtcagcaacagcgtgagctattacctggcgctggtaaagaataaagtccctgcttccctccacacctatcctatcggcggccacggctggggtttccgcgacagctttacctataagcgccaatggacgggagaattagaaaaatggctgagagaaatactgtaaaaaagcaaggagatgtggcaaaacaaaaatgactgctccgaaaagttacagatagtaattataacacttattcattggccattacctgtcacaggtgtggtataaacgtatttgaatacctatgcgacattatagaccgttgtgccgcatggcttcccaatatctatagaaaaatatcgtgatttacttccgggcaaatggaagcagacacaaaaatagccgccccaaaatccggacggctatcttttttatagcttatacgctatcgcggaaagttgtaccaatacagagtttgatgcgaccctttctttagtcttttaggatgctcaaattataaattcatatttccaaaaactggattttgacacacccactttctatttccgataaacacctgcatctttatctgcagaagacaaaaaacaggcattcgtttctctttcgcttattttcttgcgccaagttgaatatccaaatgatacaaagccacatcaccacccagcttgatcttgtccaaaataccctgaacggtagcttcctcttctacctgctcgcgtacaaatccccacaagaaatcctgagaagccttgtccttttcagcagaagcaacatctaccagtttgtcaatcaattcggaaacatggcattcatgcttgtatacatgctcgaacacatccagcggagaagcccattcctgaggaacagcatccacagcccccaccttggcttgtccgccacgtttcatcacatattgcgccaacacatcagcatgatcactctcctcatgagcctgcgctttcatccatgaagcaaaaccttcatagcctttcgcagcgaagaaataagacatggaaagataaagattggccgaccacatttcggctacaatctgagcattaattgcgtcttgtaatttttgtgaaatcataatttttattttttagttaaattgtaactgttgcaaatatataatttttctagcgattaacactatgtccattcacctttttataaaaattatattttatctcatccaagtctttgcgattcaaaagaaaagtcttacctttgcacccgctaatacgggttattagcattaattcaaatcattaattataaaaacattatttagaaatggcaactaaaatcagattgcaaagaaacggacgcaaaagctatgcgttttattcaatcgttatcgcagacgtaagagctccacgtgatggtaaatttactgaaaaaattggtacttacaaccctaataccaatcctgccacagtagatttgaattttgaacgcgcacttcattgggtaatgtgcggtgcacagcctactgacacagtacgtaacatcttgtcaaaagaaggtgtttacatgaaaaagcacttgctgggcggtgttgccaaaggcgcattcacagaagcagaagctgaagctaaattcgaagcttggaagaacaacaaacaatctggtctggctactttgaaggctaaactggatgaagcaaagaaagctgaagcaaaagctcgtttggaagctgaaaagaaagtaaatgaagaaattgccaagaaagtagctgagaagaaagctgctgaagccgctgccaaggctgaagcagaagccgctaacgctcctgctgaagaagcacctgctgctgaagctactgaagctcctgctgaagcataattcaattttacttcaaaaagaacagctcctctgatctatatcggaggagttttttatgctcttatccgaggaatcaaagggagtttatctcatcttccgaaagtccggtagggatattcagtaaatgtctctaaaaaataagatggcatatgaagatgataggggcaaaaatataagaatgaaaaatgggcgacaagatagaatcgcggagacgcttactcagtcctttcagccggcctgatggacgggaattatgccgccagcaccaccttgtacagatttcctttctccgtatgcatccgttccgcccccatggcgctcatcatcttgccgaaacgcaccaccgtcatgccgcgcatagccgcaggataacggctctgcaaaatggtgaaaatgaccgaggccgaatagagtttgaactcctctcccgcctcaggcaggcgaaaacaacggtagaacacctcctgctctacgggcatggcatagaactcgcggttgcgcaattgcagttccgcttcctcttcggccgaaaaccaataacgctcgccaccctccagctccgccttcaattgggcaaacaattgcttgtgctccagtggcgtgcagtctattttctctttcacctcggcacaaagataacggcgactgcccgtggggtcggtcagcaaatccttatgattactggttcctataaacgaagccatgcggggcaggtgactgtaggatgaacggtgcgacttacggaaatccaacttcttcatctgcatcagtgtcttgagcaacggcagtttttgaggagaaagacggtcgtactcatccagattaatcagcccgaactgcgccagtttctgttcgcagcccgactgccccgtcaactcaaaactgtccgtgtaataatctctcaacccgtcgggcatcaacaactgacaaaaagtagatttacacttgccctgcatacggctcaccaacataggggccactgcattggcgcaacggtccatgcgtcctgcccactgggcggccattcccagcatccagcggtggaagccgtttatccagaaggcttttttcgagatgcgctgcgccagcggagtgacgcgatccaccccgtcccattggggcagtgtatccatataagtaaggaaagggtgatagtcttccaagcgttccgaatggagcaggcggctcacatccttatcccagcaattgatgcgatgacggtgcgcttccaggcacaaggtgttcaaggtacgctgagtcactatcttataaggtgtgtccgtcccttgccccttcgcgcaatattcgggttgttccgtcaacacgttgaaacggaactcatagtgtttccacaagtagttctccagacggtcttgcacctcccggttatccgcagcctgttctttttcccttttatccgaagaagggtccgcctgtttcgccgttgcagtttcaccgttccataacttgcaccattccatcaccttccgaatcatttctttcatcatgattttattgtttttttagttgttgtttccacaaagatagcacattgaaaagcctttgtcaagggatttccggcgtttcgggatgaaaagtgactaagcgtaaacatccttatgtaaaagggttttcatcaggacaagttcgtgttctcctcttgacaagtacagtgtttcacttaagtgatgaagtttcatcacccaagtggtacaagctcatcactagggtgataaggtttcatcactttagtgaaacgataaacttatcaggaagcaactggatgcataacaaggaagataaaggatatgctccaagaaaagacagctaagtattttttaaaatacaggcatgacggacacacctctcatctaacaggtaggaacaaaaatatgggctggaagtaactgacaggaaactgaaggttctcctatcaggatacttccctattttacaagcagttataccggatgaatgaactgaagaagcactccggttttcatgtattgaagccccttttccatcattacagctggttcaccgctgtcaaatacttatccatcgttgtagccttctttatcgctttctttatcttccggtccgcatcgggcagcaggtattcccaataaggcttcattttactcagcaattgcgcctctccctgtaaatgggcttcataatattgaagaaggcgtgcgtgaagcgccttcaccttttcatacagctcatcgggggaaaaaacggttccgtttgcatattcccaagccaaagcaggattggccagcaacccgcgtcccagcatgacgccctccaggcggggaaactcctcgtccaccttccggatatcttccaccgtcagcaagtcaccgttatacaccaacggatgggcgcactcctcatagaaagcggtgaacgcagccaagtccacctctcccttgtactgttgcttcccgatacgaggatgcagaacgatccgccgcaagggggcagcgttcaacaaaggcaacaacggccgccattcatccgcacactcccatcccaatctcatcttgacggagaaacccagttccggatagtgcaccagctctttcaataaagcttccacctcggccggatacggcaaaatgcccgaacccttatgtttccctgtcatcaggggaaaaggacaacccatattgatatccgcttccttgtaccctttctctataaacaaaccggccagccgttccagttcggcaggagtggaagcgataagctggggaatcagccgggacacagtattgttttcagaagcgatctcccgtacatccttgttacggaactctcctttctccatccgcacaaagggggtataataagcatctatcccaccaaaaacttcctgatgaagatttctccagggggcttccgtaaaaccttgcaaaggggcagcgtacagtttcatttgtttctttttttaagtttatctgcaaagtaacacatttttcttatacctttgccttatggaaaagtatatttatgaactgaagatgaaggtacgcgattatgaatgcgacctgcagggtattgtgaacaatgccaactatcaacattatctggaacatacgcgccatgagtttctcacatcggtgggcatcagtttcgcacgcttgcacgaagaaggagtggacccggtagtggcgaggctcaccatggcgttcaaaactccgctgcgcagcggtgacgaattcgtgtccaagctctatctgaaaaaagaaggtattaaatatgtgttctatcaggacattttccgtctgcccgacatgaaagtgactgtcaaggccactgtagaatcagtatgcgtggtaaacggcagattaggggacagcgctctatttgacgagactttcgccccctatctgagcgaatgacacaagacgaacaaatttgcagcctggccctgacccggataccgggattgggaccgacaggcgcattcagactggtgagcagtctgggaagcgccacccgtgttttcgaacaccgcaaagagctgtcacaactggtccccggagtaagcgaaaagatcattactgcgttgaataactccgaagctttccggcgtgcagagcaggaactaactttctgtgagaaaaatcatatccgctgcctcaccttaaatgatgaaggttatcccggccgtttgcgtgaatgtgatgatgctccgctagctttattttaccggggaaatgccgatctgaatgcactgcatgtcatcaatatggtaggaacccgtcatgccaccccctacggacaggatatctgcacccgcttccttgccgacttgtcggtgttgtgcccaaacgccttgatagtgagcgggctggcttatggcattgatatccatgcgcatcgcgccgccctgcagaatcatttcaagaccataggcgtgctggcccacggactggaccgtatttatcctgccgaacatcggaagacagccgtcagcatgttggaacagggaggtttgctgaccgaatttacaagcggaaccaatcccgacaggcagaatttcgtgaaacgaaaccgcattgtggcaggtatgagtgacgccaccgtcgttatcgaatccgccgccaaagggggagccctcatcaccgccgaactggcggaaagttatcaccgggactgttttgcctttccgggacgatgcaacgacgaatattccataggctgcaacaatctgataagaaaaaaccaggcagtgcttatcacatcggccgaagatttagtgaaggccatgggatgggaaagtagccccaaaaccgagaaaacagtacaacgggaattgttccctgatttaagcgaggaagaggaacgaatagtaaaacgactcggcaaaatgccggaaggattacaaatcaacacattggtgatagacaccaacatacctgtaaaccgaatgagtgcattactgtttgaattagaaatgaaaggggtgatacgagcactggcaggaggagtgtaccggttaataatgtaaccatgtatcaagatactcacatacccattgacatacggtagctgtaccgtgaacgggtacatgagtatattgatgcatggttattgcactcctagttcggcaaagcccatcggtccgtcattttccaccatccgcactgctttcaacagcacatatctggctgttaccggactgaagtagaccgattggagaatcggattgttcttgatgttcgagaattccccgctgctcaccacctggttcaccgcaccggcttccgtgccgactgaaatctcataggcagctatcagtcctttgttatactcgctctggtcgggtaaataatggaaagaagaaacagtctgttccgtacctaaatccaccagaagcgtattgccatccacaaagcaagtagtggcggcatctttatccgcacattttccggcttccgcttcatctaccttcggcaatgtaaacggatatgttttcagttcctccgcttttgctgtaaacacatcaagggtttctcctgcataataagcctctatattattgatacacaggcaggcgcgtgatttctcaaagttcacgcgaagtttgtccgtagtgacagtctcaaaacgaagcaaacgtttataaccgattgtagtagtctcttcattcagtttcacaggcagccactccccttccttattatattccaccacaaaggactgtacacgctgtcccaacggaatgtattcctgcaacagcatacggtttaccttctgcggggccggccattcaaactcgataacagccgatgtgacgctatcctccgtagcccaatatgtatcatactctccatccgtcaccgcctttgccgtatattttccaccccgttcattggaaactaccggaagaacacctttcaacagattgtttgccaactgtttctgtacattcttataaaaatcaacagcattcgccgaatctgtagggtgaatcaatccatcccggtttacggggaaattaagcaataaagtcgcattatgccccacactgcggtaataaaggtctgtcaattgctccaccgtcttcacccggtcgtcctcctccggatgataaaaccagcccggacggatagacacatcacactcggcagccgtccactgattgccgtccgcatgaccgtattgcagttccctatacttaggatatcccggataaacctctccggcacgcaagaaagaccagtttgtcgctccggcaaatccattctcgttacctacccagcggcatccgggaccgccatccgagaatacaacagcctgcggctgaaacttgtcaatcatttcataggcacgcgcatagtcatagtaagtcttccggtctatggtacgggaatcttttgctccgccataccagccatcaccgccattggccccgtcaaaccagatttcaaacaccgggccataattggtcagcaactcgtacaactgtcgatagaaataatccacatattccggagttccataattggcctgatgcctgtcccacggtgagagatagacagcgaattttataccatacttcttgcaagcttccgaaagatcacgcactatatccccttttccgtctttataaggcgtgttacggatacagtattcggtcagccccgtaggccacaggcaaaatccgtcatgatgttttgccgtaaggataactcctttcatccctgccgccacaaaggttttcacccattgttcgcagtccagtttgacaggattgaatgtagcaggatcggaatctccatatccccattcacgatcattgaacgtgttcagtccgaaatgtacgaaagcgtatgtctccattttctgccaatccacctgtttcttttcaggaatggggaaaacaggttcaggagcattcacagccggagcgcaggcattcagtaatgcaacagcagctcccaagcataaaaggtttgcgtgtcttttcatttagattgtcaattaattacattgacacaaagataacataaaatccgatggatgaaaacaagaagctgaatattttaaaagacaggaaacttgacaggcaggaaaagaacaaaagcgaagggcttaaaaaaggaaaaggagcaacgctttgctccaacctttgttaaccttaaatctaatactatgaaaaaaatcacatgacaaatgtacaacttacactcattttctccaaatatttagttcaatttcgcttttcatttagtattatttcacaaatacaaccgttttcgcacacaacattacaattagattgaaaaacacggattaaaaaaggaatatgaaacattgccctatccatatgataagaccgttcatttctgtccattggaaagtaaaaagcaaaaagaaagtattcctctgattattcactccaaataaaagtaagctcccctgcccttctcattatccggctgcccaaacttgcaaattctgtccaatcgcttcactaaccctttcacgtccgaaaatagaacatttaatacgttttttttcagattttatcacctatatttgctccacacataatggtaatccatggaaaaacgcactactatattcagcatatttgtgtttttgtgcctactgaccaatagcacttatgcccggacgacagagtacgaaaatccaagagataccatattggacatgatgctctattttgacctgaaggcccgacaggcggacaaggattaccaaggaaacggtaaaacgctggcaacattggattccctgcttgcccatcctgcccgcagcagacatctttattccattattctggtttcaccggattcatataacggaaaaaaagaaccggacatagcgccgggcctaaaaagaagcgaggaagtaaaagcgttcttatgtcggaaatatccgcaagtcaatgccgcccaaatctgtatccgtacaggagaagaatacggggatgccttacggaaactgataacggacgacaggctggtccccgaccgggaggatgtattggcattgatagattatcaccatgacaatcctgtaaaaatgcaagatttcttgcaacatctggatgccggcataccttatcaatatatttccaaccggctgctaccggagctcagacggacaaaaataagagtctgcctgtcttatccggaagaaaaggaaggaaaaaactcctccacggaacaggcggccatgatagaagaaactgaattcattccgattgacagggaaacgaccattgcgccaatggcggtgcaagcactcccacaaaaggaaaggagacaagtaataacagaaacagaaaaaacagtaacaaaggcagaaaaggaaaaagagacaaaagcaaaacggggaaaaaagcccaaagaaaaggcagcaagaagagacaagacagccggcaacacagtgcttgcactgaaaaataatttattgtacgacctggcactggcgcctaatatagaaatagaaattcctgtaggaaagcggtggtcagtgaacctggaatataaaagcccctggtggtccaacagtagcaaagaaatctgctaccagctgatttcgggaggaatagaaagccgctactggctgggcaaccgtgaactgcatcaccggttgaacggacatttctttggattgtatgccgaaggaggtatctacgactttcagtttaaaggagacggctaccaaggtaaatattacggtgcggcaggattcacttatggatattccacttcagtgtcacggcatctggcattggaattcagcctgggcataggctacctgaccacggaatatcaaaagtacactccctatgaagggtcactagtttggatgagtagcgggaattacacctttataggccctacgaaagcaaaaatttcgttggtatgggtgataacaaagaagagaggaagaaaatgaaaaagacaaggtacgtagctcttgtacttttatcttcactattgactttagtgggatgcagccgacgcgagattctggacgattatcccgtaacaggaataaatatccgtttggattgggaaggagtaaccggccgtctgccggaaggaatccgggttattttctatcccaaggacgcccaaggaagaaagattgatacttacttgccggcaaaaggcggagaaatgaaagtgcccccggggcattacttggcagtgatttacaattatgacaccgaagtagtgcaagtaaaaggcgaagacagttacgaaacgataatggcgtgtacaggaaactgcacgggattgggcaacagcgaaacagaaaacatggtatggggaccggataatttttatgtggcaaccctggacgatgtagagataggaaaaggagaagagttaccgacactagaggtaagaccaaaatctgtggtaaccacttacatcttttcaataaagacagaggggctgaaaaatgtctcatcgatcattggcagtgtttccggaatggctgaatgttaccatttaggtaaaggagccggcttatgccgcttcgctcccatttattgtgaaaccggtaaagggaatggggttataaaagggagtttcacctgtttcggacatcccgaactgacgcaggcaagagctgatatcactcagtttctgaatctgatcatagtaagggtggatggttccagacaagaagcgaaagtggaaataacggaagcggtaaaacctcctgaagacgagccgggagaaggtgatgaaaaacctcaagagtccgagatagagattgagcttccagatgacgagaaaattgtagtggatgatgtagaggttcctccagatgaaagtggcggtggatttgatgggagcgttagtgactgggacgatgaaacgaatgtggaattaccggttggttaagatataaaataaagagtcatagaattattaacttaaaacacacagaatatgaagaagattttatttgcagctttagctgcactggcaatcacaagttgctcacagaatgaagaaattgaagctccgacacaaaaaacggaaattaatttccgaagcgtagttgggaagtcatccagagctgcagaagctacaactgaaaacttggaatcccaaggtttcatactttacgcctataatactaaaacaattacaatggacaaagtaacagcaggtagcttaacaacaacatttattaatgggaaaaaagcaacttgtactaactctaactggtccgtagcagatggtccatattattggccaatagccgaaaatttacaattttttgcttactcacctgaagccggcggtattacaaattatgccacaaccggtacttacccgagtttcacgtatactcttcagacgatacagacagatttactagccgcctgtgtaacagataaagcaaaaaccaatagtgcaacctctgttggaagtgtagatttaacattcaatcatattttaactcagattaatttcaagctccaaggtaaagacacaggattcaaatacaatgttacatctataaaattatcaggagttgcaaatagcggtacttatacttataacgcagataaaggtgcatggagcgctcaagctggcaatgaagaatatacatataatgctacctactctgaaattgacggtacagcaacaagcgaaattgcgacaagcagtaatgcattaatgttaatccctcagaatgatctatcgtcagtcaagattactgttacttattccacgactaatgataatggcaaagtatttgaaggaacaaaagaagccacattaaccggaacatgggatataggcaaaaaaatactttatacgttaacattacctgccggtgctgaagaattaacatttacagcccaagcggatgggtggacaaatgaagatccccaacctagcccaattgagcccaataaataaatcacatccatttgtcaggccaattataatctcctgataagaacatagcaatttcctgctccgcaatgaaacaccgtatcatccccaccatgatttgcgatttcatttgcggagcatttttacctgttgtcaatcaaccgtcctcaaaaagtatatgcgatagttatgcagctcgccaatgataccggagaaattggaggatgatactacaaattccataatctatgctgttttagccggtatacctccccgtggatacacacaaagatactttctttctgctactttcccaacaattgcaacttctttttgtttggccacacaaatttagccctctatgctcatgcccacaggctatcgttttccgtaacggcagaagacaaacaagtggaaacaggattcttcggtctttttcctgaaacttattgcaaattatccatatttgacctacatttgtcaaatcaaccaaaagaacacaagcgtttctaacatctatatatgtctggtctgccctgtaatgaaaggatggattgtacccaatgccctaaagcagtggagaacagcatccattacacacataacaaaaaaggtttccacttacccccacataagtgtgaaaccaatattttatttttcttactcaaaggtcaaatattaatcaatagtgaagaatatgccggaaccatcatcaattccggagaatttgtgctgcaagctatcgcatcaaaagtggaaatactggccatgacagactcggaaggtattctgtacacatttgatgaccctaaagccttctgctatgaccgctatacctatatattgaaaaacgtgcctccgccactcatctccgagccactgaaaataaagcccgaaataaagcttttccttgaaggggttgcttcctatctgaatgcagacaaaatttgtaaagagctgctcgaattcaagcgtaaagaactttattatctgttggcacactattacacagactatgagctatctcctgttgtacacagcctatcccaatacaccagcagttttgaatatttcatattaaagcaccacaaacaaataaagtccgtagaggagttcgcacaactgggcggctacagcgtcaccaccttccgccgcattttcaaagccatcttcaacgaaccggcctatgaatggatgatgaaacagcgcaaagaaagtatcctttaccaattgcgctatacagatgcttccatctccgaaatctgctttggacatggatttgaatctctctcacatttttccaacttctgtaagaagtcctttggcgactctcccagaaacatccgtaaaaaagaaaaggaagaaacttcacccaatacataattataaaaaaaatgccccgccaaaaggcagggcactctcaaatatcaagtaaaactaaccgtaattagtctttcagcttcgcagcaataaattcacggttcaaacgagcaatgttgctgatagaaaccagcttcggacattctgcctcacaagcacgagtgtttgtacagttaccaaagcccaattcatccattttgctcaacatagctttcgcacggcgtgcagcttccactttaccttgaggtaacagtgccaactggctgacctttgcagaaacaaacaacatagcagaaccattcttacatgcagcaacacaagcaccacaaccgatacatgcagcagcatccatagcctcatcggcaataggttttgcaataggaattgcgttagcgtcaggaataccaccggtattgattgacacgtaaccacccgcctgcataatcttgtcgtatgcgctgcggtctaccatcaagtcgcggattaccgggaaaccggcagaacgccaaggctcaacagtaatggtgtcaccgtccttgaaacgacgcatataaatctggcaggtagtagcacctgtagcaggtccgtgaggatgtccgttgatatacatagagcacataccgcagataccttcacgacagtcgtggtcgaatacgataggttctttaccttcattgataagctgctcgttcaagatatccatcatttccaggaatgaggtatcacccggaatatctttcatttggaaggtatcaaaatgtcctttgtccttaggacctttctgacgccaaactttcagtgtgaaacttatatttttatccatgatttctatacaattaataattaagacttatagttacgagtttgaaccttaacgaactgatagttcaaatcttccttgatcaattcgggttcttttccttcacctgtgtatttccagcaagctacatacgagaacttgtcatcgtgacgaagcgcttcaccctccggagtctggtgttcttcacggaagtgaccaccacaagattcctcacggttcaatgcatcgtaagccatcagctcaccgatttcgatgaaatcagccaggcggattgccttttcaagttccacattcaattcattagcttcacccggaatgcgaaggtcgctccagaaggtctttcttacttctttcagtttagccagagcagtagtcaaagattccttggtacgtcccatacctacgaagtcccacatgatgtgacccagttccttgtgaatagagtctactgaacgatgacccttgatattcatcagtttctggatcttatcgtttacagccttttcagcagccacgaattcgggaaggtctgttgagaaacggggaacctgaatctggtctgacaaatagttctggatagtataaggcaatacgaagtaaccgtcagccaatccctgcatcaatgcagatgcacccaaacggtttgcaccgtggtcagagaagttagcttcaccgatagcatacaagcccttgatagaagtcatcagttcatagtcaacccagataccacccatcgtatagtggatagccgggaagatcatcatcggagtcttgtacggattttcgtcagtgatttcttcgtacatatcgaacaagttaccgtaacgggcacgaactacatcttcacccagacggtcgatagcgtatttaaagtcaaggaatacggccagacctgtgttgttcacaccgaaaccggcgtcgcaacgttctttcgcagcacgtgaagcaacgtcacggggaaccaggttaccgaatgccggataacggcgttccaagtagaagtcacggtctgcatcaggaatatcggtcggtttcttagttcctgcctgcaatgccttggcatcttccagctttttcggaacccagatacgtccgtcattacgcaatgactcggacatcaaagtcagtttagactgcttgtcaccgtgtacagggatacaagtcgggtggatctgtgcaaagcaaggattggcaaagtaagcacctttgcggtaaacctgcatagcagccgaaccatttgacgccatagcgttggtagacaagaagtaagtattaccataaccgccggtaccgataactaccgcatgggcagcgaaacgttcaatcttacctgtaaccaaattacgggcgataataccacgggcgcgttccacaccttcgttatccttaatcagcacaacgtccaacatctcataacgagtgtacaacttcacgttaccacgctgaacttcacggctcaatgcagaataagcacccagcaacaactgctgtccggtttgaccgcgggcatagaatgtacgtgaaacctgagcaccaccgaatgaacggttatccagcaaaccaccgtattcgcgagcgaaaggaacaccttgagctacgcactggtcgatgatagcatttgacacttcggccagacgataaacgttagcttcgcgtgcacggtagtcaccacctttgattgtatcgtagaaaagacggtaaacagagtcaccatcattttgataattcttagcagcattgatacctccctgtgcagcaatagagtgtgcacgacggggagagtcctggatacagaagtttaataccttgaaacccagagcacccagtgaagcagcagccgaagcacctgccaaaccggtacctaccacaataatgtcaagacgacgtttgttggcagggtttaccaatttttgatgagctttataattggtccatttctcggctaaagcgccttcaggaattttagaatctatagtagccatattcatttacaattttatcatttacaatttacgattagcaagcaccacaagcgagtgatttcacgaagtagataacgactactgctgcaaaaccaagaactaccaaagtagagtagatgttaccaatagtcttccaacgctcgaaccagattttattgctccagcccaaagtctgcaaagcactccagaatccgtgagtcaggtggaaccacaaagctgctaaccaaatgaggtaaagcactgtaaatacagggcatccgaatgtttcacgaatgtaagcggcaccgtctgtaggaccgaatgcgcccaaatcatgaacaccgataatttcggcaaactgcattttgtaccagaaattggcaaaatgaagagccaatccggcaatgacaacaatacccaggacaagcatgttctgagatgcccattccacagttttaggtttaacgttcactgcataacgttcgctaccgcgagctgcacggttctgcatggtcaaccagaaagcgtagatgatgtgaattacaaacagagcagccagcccggcagttgcaaccaacgcgtaccagttagctcccaagaattcacaaatcatgttgtaagcatcttccgagaagagcgcaacaaggttcatcgccatgtgaaacgtcagaaacaggacaagggcgatacctgtgacactcatcaccactttccttccaatagatgaattacttaaccacataaatgattgaatttaaattatttaattgttagaactaaaaattctgttaaaagctgtgtattcacgatgcaaaagtaaaggaattctagcgataatacaaggaattatggaaattattctttaattcggggaagggtaaatgcgaattacattattttcctatctttgcactgaacaaatgccaaactaaatgaaacgccaaaggattatttttcttatactgacagcctgttttacattcagcctcagcgcacagaatatagacatcaacacgttgaaaaccatcaaccgatgggatgtacacggactgagccgcggattgtccgctagcggagtgattctacccgtaggaatacctacagccatgggactctatgcattgataaagaaagaccagccgatgctgaaagatgccatttacataggaaccagtgtgattgaagcagtggggattacatacgccgccaaacatataataggtcgtgaccggccttttgtaaagtatccggataagattcatgcatacggagcaccggatgccgatagtccgtcattcccttcaggacacactgcggcagctttttctttagccacctcactctccatcacttatcctaagtggtatgttatcgccccttcagccgtatgggcttgcggagtagggtttgcccggatgaaccaaggggtgcactatcccagtgatgtagtggcaggagccgctatcggagtaggatgtgctttcgtgaacgtgtatgtgaaccgatggctgaataaggtgctgttcgggagacagataaagtgatggttggaaaattattccacacctaaaagaagacacaacagaagtttttcagacaactgcaggagtgcaactatgcgcccctgcagttaatataaagtcttgactatcgctttttcaacagcagcccctcaaagtccggttgctccaacagttccagcgctttcctgatactttcattcgcgtcattaatgacgtgataatattcattcatatcccataaatcacgggctatcaatgctttcatctgcaacctcagcagaggcagggccttttgatactcttcttcattatattccactcccatctccttgccggtagcaaccaattgtgccaacatatccggagtcacttcaaaacgtttgtagaactcattgaaagtcttgtatttgcccagccattctttacgatgggcatcaataaaatggaaatgagctttcatcaacgctcctttatcacgcaactgacgatggtatttagtatagagagtcgtatcaatcggcacaaaataatcgggcatgatccctccgccaccatataccgtacgggccaacctatgagtcttgaacttcagtgaatccggaaagtggatgctgtcttcactcatcatttctcctttattataacggtctatcaggtcttcattatacttttcaatgctctcgtaaggtttctggatacaacgtccggcaggcgtataatagcgggccaccgtcagacggatcatcgaaccgtccggcaaatcaatgggacgctgcaccaagcctttaccaaaactgcgccggcccacaacaactcctctgtcccaatcctgaacagctccggtcacaatctcactggcagaagccgaaaattcatcaaccaataccatcagacgaccgttctgaaactcgcccgtacctttggcaaaaaactcgctacgaggattacgacggccctccgtatagacaatcagttcctttttacccaaaaattcattggcaatatcgatagcagcattcaaataccccccgccattgccctgcaaatcaagaatcaagtctttcattcctttcttctgcaacccggtcagcgctttcttgaactcctcatgggtagtggcggcaaaacggttgatacgaatataaccgatcttatctttaatcatataggaagcatccaggctgtaaacaggtattttatcccttttcaccgtaaaggggagcagttccttcacccctcggcgaagtattttcagattcacttttgaatctttaggaccacggagacgacgcataatatcctcggtactcatctttacaccggctatcagcgtatcttccaccatgacgatacgatcaccggccagaataccgactttttcggacggtccgcccgatacaggttgtatcaccagcaaagtgtcctccgccatattaaactgtataccgataccttcgaagtttccctgcaacggctcgttcattctcttcacttcctccggatcagaataggtagaatgaggatcaagctgctccagcatttttacgatagcttcttccaccagctttccctcattgacttcgtctacataaagattggcaatggcaaattccgccagttgcaacttacgtgccggagaattcaggaatttactctcctgagcctgtgcggctacgatagaaaaaaagcaggcaatcaagcctgcaaaatacatagtatatttcatggtcagtctattttcattccttcaggcaagaatggcgtcacatctttgccaaactgcaacaattctcttacaatcgtagagctgatagaggttagttccggctccgtaaacaacagaatcgtttctattccggccagtttccggttgatatcggctatagtttcctcatattcaaaatcgtgtacggtacggataccacgaacaatgaactgcgcctccttagctcgggcaaagtcaatggtcagacaatcataagcatcgacctttacccggggatcatccgcaaaaagtttctcgatcatctccactcgtttctctgtaggaaaccaagttttcttattctcattgataccgatgccgatcaccacttcgtccataaaagtcaacgctctcttcacgaccgaataatgaccgatggtaaaaggatcaaaggttcccggaaatatcgctcttctcatattttttagtgattcactcacgcaatatcttcttctacaacaaggttatctataataaaattctgacgttccatcgtgttcttacccatgtagaactccagtaattcctttaccagatcagtcttgcggagggaaacttgctccaaacgcatatctttgccgataaagtgcttgaattcatcgggtgaaatctctcccaaacctttgaaccgtgtgatttcgggattggggcttaaccgttcgattgcggcaacccgttcttcttccgaataacaatataccgtttcataaactcctttcttgcggttacggacacggaacaaaggagtctgaaggatatatacatgacctttctttatcaaatcggggaagaattgcaggaagaaggtaatcagcaacaaacggatgtgcataccgtccacatcggcatctgttgccacaatcactttgttatatcgtaatccttccataccgtcctctatgttcagagcagcctgaagcaagttaaactcttcattctcatatacaatcttcttggtcagcccgtaagaattcaacggcttaccacgcaaactgaatactgcctgagtatttacatcacggctcttggtgatagaaccgctcgccgagtcaccctcggtaatgaaaatgcagctttcctccttcttgtctcctttggcatcattcaggtgaaaacggcagtcacgcaacttacggttatgaagatttgcctttttggcacgttcacgtgccagtttggtcactccggctatagccttacgctctttctccgattcttgaatcttctgcaacatcacatcggccacatccgtatgtttgtgcagatagttatcgacctcagtctttacaaaatcacctacaaacttattaacggtaggaccaccgggagccatattggtagagcccagcttgattttagtctgactttcgaacaacggttcctccacattaacggcaatggcagctaccaatccgttacggatatcggcatagtccatattcttgttgaaatattccttgatggtacgggctatatgctctttgaaagcactttggtgcgtacctccctgtgtggtgtgctgtccgttgacaaaagagtaatattcctcaccatactggccggtatgcgtaaaagcgatctcgatatcttctcctttcaagtggatgatgggatataatcccacagccgtcatgttgtcgttaagcaagtccaccaacccgttacgggacaggatacgctgaccgttatagataatggccagtcctgtattcagataggtatagttgcggagcatggtttccacgaactccggacggaaactgtagttctcaaacaacaggttatccggttcaaagaaaatataggtaccgttctcctctgttgtatcttgtgtggtatccgtcaacaagtctcccttggcaaaggtagcgatacgcacctttccatcacgatagctgcgcacctcgaaacgtgaactcaatgcgttgacggctttcacaccgaccccattcagtccgacgctcttcttgaacgccttgctgtcatatttacctcccgtattcaacacactaacagcttcaatgagttttccctgcggaataccccggccataatcacgcacgctgacacggagattttcttcaataataatctcaatctttttacccgcctgcattttaaattcatcgatactgttatcgataatttctttcaaaagaacgtagataccgtcctcggcatgtgatccgtcacccaactttccaatatacataccgggacgggtacgcacatgctccatgtcactgaggtggcggatattatcgtcggtatattctacggcgggattgtttatcagttcgttgttttcttccatattgacttatcacatttttatatatcgttgttacagaatactctttttataagcacgacggcgtttatgctgctcggtcttgaaatattcccactgggcctgcacctttccgttcagttccagttccggattactttcggcatactcgaatcccagctgctgatatacggggatcaagtccgagaataacaaagcattgacacctttgttctgatactcaggttttacagcaaccagcaacaaatccaacataggaggatacttatgcaggaacaacactttcaacaggtgataccatcccataggcagcaaacgtcccttcgctttttgtaacgcttcggacagagaaggcattgaaatccccactgccaccagtttatcttcggcatcggtcaccaaggttaccatacgcaaatctacaataggcaaatacatctttatatactggttgatctgtccttgcgacaaagccgagaaaccataaagcggagcataagcctcattcatcaactcgaatatagcctgtccatattcggccgcaattttcttacccgatgtatatttcttcaccttcaggttaaacttacgttgaatcaagtcactgatacgcttatgcttatcaggaattgcatccggaatataaattttatattccacccaatcggcatccttctcgaatcccaacttctccatatgctgtgggtaataaggataattatagatagtcgccatggtgctcaactggtcgaatccttctaccagcataccctccgcatcaaagtcggtaaagcctaaaggcccctgaatggtatccataccttttgatttaccccattgggctactgcatccaacaaggcacgtgatatttcgatatcatccagaaaatcgatccatccgaaacgaacttcttttttattccaagtctcgtttgcgcgtttatttataatccctgcaatacgtcctaccaccttgttatccttatatgccagaaaatactccgcctcacaaaactcgaaagcggcattcttcttcgggctgaacgtattcagcatatcatcgtacaaatcgggtacggaatagggattctctttgtataactcgtagttgaaccgtataaacgtctttagttctttctttgaactgacttttttaatggtaatagccatgctgtatttttataaaattcggggtgtaaagatagaagtttttttgcagaaaacttattctttttatggctttttcactgttgggcaataagataggcggtataaacgacataacagccaaccatcaatgcgccttcaagccgggttatggtacgtttgcggaaaaaccagcctaccagccacaacaacagggaggaagcaatcagtacacttaaatcgaggttatttatattccccatcggaagcggtgacaccgtagcgctgcaccccagaacaaagaatatattgaacagattactaccgatgacattgccgatagcaattcccggattcttctttaaagccgccgtaacagatgtggcaagttccggcaaggaagtacctccggctaccaatgtcagtccgattaccgattcactgacaccccatgaacgggcaagcccgcttgccccgtcgacaaaaagctgtccgccgaatatgagtccggccagccctcctgcaatatacaacaccgatttccatacaggcatttcctttatcttctgctcctctcctgcctcatctgccccattacgggcgatggcaaatgtataacgcataaatataaggaagaaagccagcagaacaaacccatcggaacggctgataacattgaccgcttccctgtccagcatcatgtcattggcacagacaaaaagtaccaacgaagaaagaatgactaacggaatctctttactcatcgtcccctcacctacttttatggggagtaccaaggcagtacaacctataatcatcaaagcattgaatatattactacccaccacattaccaatagccatttcagcactgccattcaatgcagaaagcacactgataaccaattcgggagccgaagtgccgaaagctacaatggtaagcccgattaccaaatcagaaatacggaaacgtttggcaaccgctgcagaaccatccgtcaagccattcgcgccagctaaaatgagagccagaccaccaatcaaaaggagtgtattcaacataacaaaaagtacatttacagttttataccgcaaatgtactctttttccctaaaataactattcctatttggtgcgttttacagtatagattacttttcctttcttatcaatcatgtgcatatccagttctttcttgtctgccgtaaagatagaaaagcccggttcgggactacagaacagagtgccttccactggttttaccttacggctcaacgaaccagccgaatttaccacatagtcgatatcactgcccggcacacgaaggtgctggaagttatgaatgtgtccgcatgcatagatatccaccttatgtttacggaggataggatccagacgcttctgcatatcgctgcgttcactgtcgtctttcgacgtttcagcataaatgggatgatgtccgattacgactacccaatcttctttggcaacagtcagtacagaatctatccatgccaattgctgatccatatcttgtttacaggcatccggataagtttcgctctcgttacggtatttgtcaatcagaggagcggtatctatcatcacaaaacggatggcagttcctttcttctcaaagactttggtataataacgaccaggcatcgaccagcgacgactcacattggtataatccaacacagcctgcgtattaccccggtattcatgatttcccaagatcggaaaccagtctatcatcaactcgggatgactgtaaatcaactcgtagttggtcatccagagcggatcgttaacgctgcgcacaccttcaaaatggtgcacgtctccggctgcaaatacacactcgggaccaataacatccgccatttctcccatcaactcggctatgggcttctggtcataataaccgttacgtcccaaatcgttggccatataaaaattcagttgtttctccagtcctttccaatcttgcggagtctgggcacacacattcaggcagatagccgtaccaatgacggcaatccatacccatgtcaatacttctttcattcttctaatcatcatcaacgttttcatatacttatttttagaaacttatttttaaacctgcattcattctcacgccataatattctgcctgcatagtacgatccttcgttccctggtaataacggagcggctggttcagcagattgttcgcctcagcataaaaggtcattttcaccttcttgccaaaggtataactggcgttcacatccatatagttcacagcatcataatatctgtcataaaatgtacttgggcccatttcatcgataaaatcagatgcaaagttatagctcaggcgcacattcaagccttctttttcaaagtaaagagaggcattcgccgtatgctcgggagaccccggcaaactcaacccgctctcgttctcacgtccttcgaagttaaagtcctccacgcgtgagtgcgtataagtataggttccatagaaacccacatacttcaaggccggagcaatgaagccgaaatcacgctgataagaaaattccaatccccacagattagcatttcctgcattcttgggctgagtgaaacgggtatattctgttccttggtattcatagttggtcagtacctgatctacgatgaaatcgtctattttcttatagaaaaaacctgcgctcactaaacctacactcttgaaataataatcggcactcaaatcaaagttataagaaatagtcggtttcaagtcagaattaccaatctttatttcattatcaccacggttgatattcacactgggaaccaaagctgaatatttgggccggctcaaggtctgcgtgtaagaaccgcgtatcttgaaatcatcatttacatcccatttcaccaaaatagaaggaaggaaattcacataactgttggtcatgcggccggtcttggtggtcttatctgtctcatcatcatagttacggccggtataacgaagggaagtatgttccatacggagtcccgccatcaggtttatatcggaagcgaatttatgatcaaaccgcacatacccggaacttacagtttcacgagcctcaaagttctcagccaattcggcttgtacctgttctttatcgaactgggaagcatcatttaaattcaatccacccacatattctttactggcaaatgttcctacctgatatttgtcgctcggcataaacttatccgtactctggtctaccgtatttttcaggctgttggtcatgaaggcatcctcgtctttcggagtatattcgtagaagtctatttctttctcttttgttttacgtactaccttcgcaccgaacttcagtttagctccattatttaaactggccttgaaattggccgagaatttcatatcttcttctttgatgtcctcctgttgttccgtcagttccttcaagctgaacttatcactcagtgtcaaagtagaacctgttccaggtgttgccaacggctggcgttcatcactcaagtccatatcaaattcctgctttttcagttggaagtcaagataacgttcattagggcgttcttccgtagcttttgcataactggcattccaatccataccgattgccccccataagtgttctccgcccaaagcgaaatccatggtacgctgacgctccagacgggcattgcgattatcgggagtacctgctttggtctggatgcggactgtgccttttccgttctcatccaaatccttgatattggtacggtaacggttttcccaatcgttacggttgttgaagatccctttgaaagtcaatttatggttttcattgatatcaaaatcaaaagccgccgaataactttgacgttcacgggtgacaaagtactggcgcatctgataatcgctgacatatactttgccatcttcattttgttcccacatgaattcagtatcataagaaccggaaggagcattctgataagaagcggagagcagcatacccagtctgtcattgaagaaacgatcgccgtaagtgaaacctaagttcaactgggctttctcgctgatccagttgtaaccacttcccgctgtagcattgatagtgcgtttataaggagaatttttggttaccagattgatggaaccaccgatagcatcgccgtccatatcgggtgtaacgactttgcttacttcgatggtctgaatcatatcggcaggaatcaagtccaactgcacgttacgggtatccccttcagcagatgggacacggttgccgttaatggtgacggagcttaaatcggcactagtgccgcggacctgtccgaaacgggcctcgccttgatcgtattgcacattgatgccactgatacgtttcaatgcatcacctatgtttgagtcgggaaatttccctacctgatcggcagatacaacattagtgatacccagattattcttttgtgtattgattgctttcttctgtccttgaaaagctccctttacctgcacttcctgcagttccaccccttcattcatcactatatctttttctaaagtcttgccttcggggacggtaactttcatttcaatggggctataacctacgtaggttactttaactgtgtaagttccgggtttcagattgggcagcgtataaaaaccgttcacatcactgattactccggttttcagattttcaacaaagatggaagcacccggcagaatttgttttccattgtctatcacacgtccgcggatagcgccttgccggacaatgttttcattttcctcggcaaatgcatttccacaaacacctgccatcagcagcataagagacacagctctaacaacctttttcatatacttttttatgcgttataaatctgccgcaaaagtagatgggtcaggtttcttgagagttacactctattaaaggtttcgtgacaaaggagtttcattcctgttacaagatattcggtgcaagacgacggatacaaagcatggacaaggcttacaaaacagcagagtaagatttttcttactcatgcgatcactctttcgtaacttttgaaaaggaacaggtataatatgattaagaaagaaatactttcacagattatcgtaatgctgttatccttgctatgggtaaatgcactgctatctggatccatagggaacttaccggacagaagaagtctctccggacacaaaaaaagaagctgacagcccggattatctggttgaactgtcaacttttcgactacaagcctgagaaaccgttctcttttgaccctgctacaatttataactataatcttttgtattgaaaatcacataaatatcctaaacaaacacccccttcaataatttttaaatgacactttttcccacgactgcttatataaatcgatcattagctaattcatcatacaaagccgccatccacccaaataattcatcagcttaaaataccaactactagttgcaataggtgttccactttctcctttctgcataacaatcgtacacttcacctcgtttttaacaggagtatagaactttatataatctatcttataacttaatacaggaaaagattccagcatttttgcgacttgatgcaattcattgttatccaattgaataggttcattccaaacatctgccaaatcggctttataaagcatagctgcggcagattccagctgaccatttttcgcatattccataaattgatttattaggtttgttatcaaaaccgtatcaacttccgttagatgagctacaaattcattaatactcttctcttctttgctttgcaccttctgttttcctgattgacaagaaaaggttgttaataaaacagtcaacaataaaataaatttcagttttttcatttcattctttcctcctattaaaaaaggccagccactatgaatggccggcccttatttaaattaaactcaaagttattacaatattagttctgaatagtcttattgatattcaaatcaacttcggtatagatagtaccccacttataagtaacttccagcggaacgcggattgtaaacttacctaaagtagtaccattattgtaataatagaatttaccattatcgccaaccttcagagcagtaaatacattggttgtagatttatcttcaccgaaatacaattttacattcttcgttacagaagataatttagtagaacctaatgttccaccattcaaagttgttgtagcgttttcaatatcagcagcaactttagttacgccataaaatccatagaaattatatttcttaccatcatcaccagtagtatcttctgctttatcaaaatacttgtctctccaatcaatcagattcaaggtcaagcctgcaatagaagcaccattagtagcatcaattaattcatctacatctgacggatctactgatacaggacgcaaatatttagcatagaatacgttgttacccaaagcataatctacataatcgcagttagcagcattaatttgcaatttagcagtaaatgtctggtcttgtcccagcaagttgtgatctgcattgttcaaaatatcttttgcaaaatcattttcttgatattccatcactgttccagcaagaacaacaactgcttttgttacagcgttattagtagcttgtagagtttttccatcagcagatacagtgatatcatattgagcaccagaagcaccattcacgacataagcagttcccttcttagtcaaatgatcttgagggttagcaaatacaacttccttagtcaacttatcattagcaaatgcaggataagtagcgtcacttgtcacggtaatcacattaccagtgaaagtattcaagatttcgctatcaaatgtacaatcattagagttatcgctaacaacttgatgaacattagcatggatatctgaataaccagaacctgctacagcaccgttcttttcataccaatatttatcaatcttagcagagttttcaatggtaccattaggagtaaagttcaaaggactaggagtccaagtgaaagtaacatatacatattgatatacaccttcagatacttcatagctataacgtacatttactgcaatactcttagcaccagccttaaagatgtgatatgcctgattattcttaactacccaagtcaaaacttcagtcatttcatccgccggatcccaattagtctgtgaaaccacaccaaccggagtagtaacagccttagaatcaacagtaattccatcatactgagtagcatttaccaaagcttgttgctctacgtcttctacagcaccatccaatttgaaattcttatggaattcatccttagaaataccaatttcttccaattgagccagaatctgttcttcaacttgatgccatgacaaaccaagtttagtctctgtttctgtacaatcaacagtataaccattagcaaatgggaaattcggggtcaatacaacttcattctgattagcagtatcggtaatcttgaattttaaataaccaacagaagctatttttccgctaatagtatcagtcaagataacacgaaccaacggttcacgatcttttgtagctttattctgagtaaatccccaaggttgctgcttaccaccacttgtcatctgaggacgaataacagaacccttcaatgcagcatgagcactttctgaagtttcgttattacctttatgataaccaactaattcgtaagaatatttgaaaccatatttttctacagtaccatcagcagcacgaacatcccattttgaatgtgtaccttctttatctatattagttctgtgagtattaaccaaacgagcaatatcgataccattgctgttccagacaatcttgcaaacatgttcattatcagcaatagcttcagcagcagttgtaaacaagtggcggtcatttgcatgaatactatctacagctgccaataccaagtccttgtaataagcagccttaacagcagcataatcagaagtaacaacggtatcccccttacttacttgcaaagctaatacagttacttgctcatcattttcaatgttcttaatatcagcatctgtaaaatgagcatttacagtcaatatacccttgggggccttaccgtttgtaacattagtttttactactttcggagctgtcgcagcagaacgagtataattcttgtcataacgcaagaaagtatatgcttttacatcacctggaacttttgctacggtaggatttacatgataatcagctaccaagtccggaatcattgtagttgcttcacctacaacaggaacatccttatcataatttccatctgcatctactttagctactgtcaaggttttataattaagaccaatagcttccattgcttcaataccgtgataatagaatgcaggttggaatactaacgccttcaaatcagcaaccaaagagaatgtagcagattttccatctagttcaatgacatagccaatcacctcaccagtttcttcatctttcacttctgtaatagaaccaacgctttgaggtttctctacacctgagatttttacatctccataatacagatagccattgttccacttcaacaaagtaggatcaaatgccgcaggagcatcagttgtaggcaggggtgcttcagaaacgaccttgtcaccatctaacaactgtatcttaccatctacaactttcaaagagtaagtgggaagttcagcaggcatcggaagttggaaagtttcaccgttaccgccggtaacagtcaacttacctgttgccgcatcatacttgacagctgtgacatattttccagctgcggcctgtaattcagacaaatctttagtcagcttgtccactttctcgttcaagctgtcgatgtcatcatcatagtccttacaagatacaaatgttcctgtcgaggtaaccatcaaggcaccaaacaggattgcacttaaaaactttttgttcataatagaaaaactttaaatttataaatttaaaaaactaaaattgattatacataaatcattgattctaagagcgaattattctgttctcgagctagaaagcgcaaaggagacattccgactattttactaaaagaggcataaaaagcacttctagaggcaaagccacatcgctgtgggagttcttctaatgaacatttcccagcatggagtaactctttggcatattccacacggtaagtattcagcaactccttcaaattgcagttgaaatacttgtttaccacattcgacaggtaagtttggttggtgtctatcataacgctaaactttttcaaagaaagctccgaatccaaaaaaacttgctttatttcaaggttatacaatatacatttatatagggcacaatccacctttctcccttcagtccccttattggcgaactgtagttcccactggcgttcagcagccttaagaagcaggcttttctgcctattcgaagtagcagtccgtctgtgtcgtctcaagaatagatagtccatatttttatttacttttaatcttcgctttaacatcttcacaaccatacattattatatggcgtgtcatcagttatacgatagatctcttattaagagatatataagagatctataacacattataaatcaacaaaatacattcacacaagaatactttgaaagactaaatcatgtattcagaaaacgttttttttgaatcaattattaaatttccttgctaaattgttctaattctcaaaactttgcttaaatttgcgacaaaatatatatctcttaataagagatatataatattccaacttagtattttttctataaagttcttgtaataagagtattatctccaaaatcaaagaataaaatccaagtaaactttgccttttcttttattcaagtttgtctattaaaaaatagctgtatcagctataattcacataaaaaaacaaacctatgacaattgtcatattacggaaaaatattgaatatttggaagctgatatttttttcataacaaataggtggacaaaaacagcataatggtttatggcaattgtttcagaatctatctgtaatccgattctcctttactataaggtatcttctgacaaaagataacaataaagagatcataggctgtgccgaccttgcaacaaacatattcaactcagccacatcagaaagtgctatcatctttagagagaacaaacacacatttattaaaaaaatactagacacactgatcccgtcaaatggaggataccttgtgatatgatatcctctttttgacaagaaacaatatctttaccctattatcacaagaattccctcagcaccaccatattcgctttgtctatcacggtggtatccaatgctgccagataaatcaaagtcgttttttccgaatcatgtcccatcccttcacttatcacagaaagaggaatatgtttgcctctggcaacactggcccatgaatggcgcgccacatacatagtcaaaggatgaacaagccccaactttttccctatttcttttagccttctgttcaccaagcaaattgaatttttatattgcaatctttcatctttcctgatatgaattataataggaagcagataagtcgaatagtttccgggatatttatccactatatcctgcatgcatttctcccatctgatggaaagcaactgaccggttttctttcttctataagtcagcataccattatttaaatctgtttttttaagaaaagccatgtccacaaatgacattccccgggtataaaagctgaacataaacatatcacgcgcaaactccattgactgagagtgacttaaatccatctccttcagttgtctgattactttaaaagaaatggcccgcttcaccgttttttccactcccgtatagacgtgcttaaaaggaaaacgctgtctgatcacccctttatctactgcacgattatacgttgcacgcaaaatacgcatataaaaagaaacggtgttcatacttgctccctgctcctttaaataagtttcataccccatcatcaactcggcatccatattgctcaacagaacatccttgccatccataaatttcataaaactgttcagtgtagctctatacgtctcactggtacgcaattttcccgattgtctcagactggcaatattcacttgcataaaggaagacagtgtcttcttacctgaaaaggataatcttttacttcttactctagttgattccaccataatacttgtttttaagttgattctttttttctgtaaaaacctcaagccaagataaacgattattcccagcggtcctttataaggtatgcaataggggagattgttcaaagaaacaggaatttttcactgcatttaaaaacaaaaacgcatgtttattccttttaaagaattatatttgtagaagaaagccacaaacctgtgtctatgatgaaaagaatagaattcatatatttattgaccggtttctgtacaatctgctcgtgtacctcgaaagcaaatagcgaaattaaggaagtgataacagaggtacacaatactgtgacagaagccatcaccgagattgtagaaaaagatatcaaacccgaagacatcaggcttgacaaggaactgctgtatgataaacatactttgaaggatacctatccttataaagacaccacccgccatttccaatgggagaaaataaaggagcggctggcattgttggagaatattcgaaaaaagccggcacaatggtgcatcttacagaattataaaaaccggaacggagaagcgcctttagtgaaaagttttaaaagggatgcatacaaacggatagccgacacattgggagtggaacgctatcagggaattcctcttttcctaacagatgacacccttactgccgaacgctacggactggatggacttcttacccgtcacctaggtgaggaaggaaagttcaccaaagtagaacctgtctttataggtggcgaatggtatgctccgacaaaatatataaaactgattcccgacagcgtagtgttcaacaaagctatttttatagaccgccataatcagaatataactactttggaacggaaagaaaagggctactggctgatacgtagcatgaatcctgctacaacaggacaacatcgtcctccatacgcccaagaaactccattgggtatgttcgttctgcaagagaaaaagaccaagatgatttttctaaaagacggttctgccgccaccggtggttttgcaccttacgccagccgtttcaataatggtggttatattcacggagtacccaccaatgcaccggcaacagggatcatagaatacagttatacgttgggtaccatcccccgctcacatatgtgtgtaagaaatgccacctctcatgccaagtttattttcgaatgggcacctgttaatgagacgattatatttgttttggaatagaaatgtgcgtaactttgcacccgttatccagtttttccatacgtatgcagaaagcttttttactcctgttcctattcctctttccgtcgagcaatgtatcgacccggacggctacacccgaaaagaaagttgctacatctgtccctgcacctcaaaaaatggacggcgaacaattattcgaagatatgcaattgggaggggtggtcaatttcctggcattccgacaggctgtggcaggatacaacttgattaaacaaaaaagcaaatccatactgacattgattgatttcaccaaaccctctaccgaaaaacgtttgtttgtctttgacatggaacagaaaaagatgctatactcatcagtggtctctcatgggaaaaacagcggcgagaactatgctacctctttctccaacgaagtcggctcttataaaagttccctcggcttctatcttaccggaaacacttatcaaggcagaaacggatactcccttttattggacgggctggaaaaaggaatcaatgaccgggcccgtgaacgtgccatcgtagttcatggcgccgcatacgccaacccttccgtctgcaaatcaggcagactgggacgaagcttcggttgtccggctttaccacaggcactgaccaaacctattatcaatacgataaaagggggaagcgtactctttatctatgccaataataaagagtatatggctaaaagctctattttgcctaaccagacatcacaagaattatttactgaagcatgtgaaagtgagcaaaccgtttcagctcatttatagtttctcctcaagcggttccttcattatttcttagttattttcttttcttctgatttcaaacggcgttccactttctttaaatcttcgcctgctgacaattgttccggatagattccccggcttaccatcatattccgaacagccgtattattctcaatatgttctttttcaattgatgactgtccataaagatctttttgttgtacgttaatagaagccatctcggcagcaaaatcttttgccttaatgctgatggttggtaagaaatcggccagcagacgactgtcgggcgcaccaagtttacgttttaacaacgctgtgtcaagacaaaacaaggctttatctccttttgaacggataatggcaaaacctttactatctactccgcgttcataaagcacacccgataacagcttttccgtttcagccaattcagtccgtgcttgaacccgctcataatccaacagacgttgttccaccaattctgcacgccttgtctgaacagcaaagtagttttgagcaaaagctatagccggtttacgcgcatcaccgttttgagcagtcaaataacaggcataacgggtaagatagatatcatctatctctctttctacaccagaccccacagaaaccattttgctgacatcagcaaaatggtaggccacatcttcacctgcattcgtgcaagcagctttcgctttattgatgatggtctcaaagtttctccactgggtataacccaataaggaatacaactcgcgtacactccaacactttactccatgataatcacaaacgatactttcaaactgcttgaactaatcttttatttcctcggttttcatcatatatcccccccttattacttgttattacgtcaatgccctccttctactacagaattcacactgcatatttgcacaaatataaccttttattatcagatccgaccaacaaaactctttttcctaactatttcgattcttatattatccgtttcttctagaacagacttattccaagagttattttacatttcattagtatccatttcaaagcatatttaaatccataaaaaacatttttctttatatacccgacaaatagcaaactaccaaacgtcttttttactctttttgatattctttaaactcgcgagaatcgcttaaacgcttccttctcgtcccgttcatcgaaataatcaaatgagagagtagtttgcccttaaaatcatttcatactattttgctatcgtgttcaaacaaagattggaaataaaaataagagaattgaatcttttctaattcaaaaacgaataatttgactacttttgtccgagttattactaataaaactagcgatatggttttgaactacatttggatagccttttttctgatagccttcgtgacagcgttgatgcgactcgttttcctaggcgacacacaagtgtttcccgaaattatcaactctactttcaattcctccaaaaccgcttttgagatttcattgggactgaccggtgtcctttctctttggctgggtatcatgagaataggtgaacagggcggagtcatcactctgttttcccgattgctgggacctctgttcagcaaactttttcccgatattcccaaaggacatccagtaacaggcagtatctttatgaacctggcggccaatatgctggggctggataatgccgccactcccttaggactgaaagcaatggagggcctgcaagaattgaaccccaagaaagatactgccagcaatcccatgatcatgtttctggtactgaatacatcagggcttacactgattcctatcagcatcatggtatatcgtgcacagctgggagcaacccaacctacagatatatttgtacccatcctgctggcaaccttcttctccactttggcaggcattgtagcagtaagtatttatcagagaatcaatctgtttaaccgcactatcctcctctttttaggaggaatgagtttgctggtagcaggaattatttatttcttcaataccttgtcacgagatcagatagatatttactccaccactttcgccaatgttttcctattccttatcatcatcggctttattgtggcagggatcagaaaaagaatcaatgtctatgactcctttgtcgaaggggccaaagaaggattcagcaccgccgtgcgcatcattccttatctggtagccatactggtaggtatcggagtcttccgcgcatcgggtgcgatggactatttgattgacggtatcggcaacgccgtaaagctatgcggtatcgacagtgatttcgtaggagcgctccctacggcgctgatgaaacctttgagcggaagcggggcacgagggttgatggtagatgccatgaccacatacggtcccgattcctttgtaggccgactgtcctgtatcttccaaggctccacagacaccaccttttatattctggcggtatatttcggcagcgtaggaatagtgaggacacgccacgccgttccttgcggactgctagccgatgcggcaggggtcattgcagctattcttatctgttatcttttcttcggctgaaatactttccttatctttgtacattataaaaaaataatcagcctatgataagttatcaaaccgaaggggtaaaaatgcccgatatcaaaaagaaaaaaaccaccggatggattaaagaagtagccgcctgctatggaaaaagagtgggagaaatcgcctacatcttctgttcggacgataaaattctggaagtgaaccgacagtatctgcaacatgattattacacggatatcatcactttcgactattgtgaaggcgaccgtatttccggcgacttattcatcagcttggatactgtccgcagcaatgcagaacaatttgagcaaccctacgaccgcgagcttcaccgggtgattattcatggtatcctgcacttgtgcggcatcaacgacaaaggccccggtgaacgggagattatggaagccgccgaaaacaaagcgctggcattgatttccctataacaggacatacaaggcagaacaacctataaaagctacgggcatagttcgcaagaatgattgcccgtaaccttttaaagacatgcccataattaggaaaactttccgccggacggataaaaaacgtcgaaagctgtacatacacagctacatttcttcccttatcttcttgctttttcggattaattgctttattttgtgaattgaaaaacagataaacacaaaatatatggaagctaacgtatattttttcgctgcattagtaagtacgggaatctttcttctgcaattcatcttatccatctttttcggcagtatggacaccgacatagacgttaatgccgatggcaacgccgatatagacatgagcagcgtactctccttcaaaggactgattcatttctgcatgggtttcggttggttcatgtatttatgccagcctccctacattgtcttacattacctgggcgccgtgataagcggcagcttttttgtcttcgtcctagcttggatttataaactctgctataagctgaaacaagaaaacaagcccgaacagggagaagaattaataggcaggaaatgcgaaatatatacccgctgccaagaacaagaacaggcaggaacaaactatgtggtctatatcgccatcaatggcgcacaaagagaacttaccgtgcggagcatacagggtaaaagctaccgggaaggcgatatcctcacactgaaggattacaaggaaggaatctattatattgattaaataaaccctaaaaacgcaatcatttatggatgagcagattctcatttatgcagctattctggtagctgtcatcgtcctgaccatcgtcgggattttaagtcgttaccgcaagtgcaagagcgacgaggtattggtagtatatggtaagaccggcgacaagaaatcggctaaactgtatcacggaggagccgcttttgtatggcccattatccagggatactctttcctgaacatgaaacccatgcagattgactgcaaactgaccggtgccatttccaaacaaaacatccgcgtagatgtgcccactaccatcactgtggccgtaagcacagagcccgaagttatgcagaatgcagccgaacgcttactgggactgaatatcgaagcacaacaggaactgattaaagacgttgtttacggacaaatgcgtctggtcattgccgacatgaccatcgaacaactgaacagtgatcgtgatacattccttgagaactgccgcaagaacatcgactccgaattgaagaaattcggtctttacctgatgaacatcaacatcagcgatatccgcgatgaagccgattatatcgtcaatctgggaaaagaagccgaagcgaaagccaagaacgaagccttggctaacattgaagaacaacagaaactgggtgccatcaagattgcggaacaacaaaaagaacgtgccaccaaagtagcggaaaccaaccgcgacaagaacactcaactggccgatacgcaacgtgacgaggaaattaaagtagccatagccgacaaggaacgtgaatcgaaagtagcagaagaaaatgccgaaaaagaatcacgtatcgccaaagccagcgcctctatggaggtgaacaaggaacaggcgcgtaccgaacaggaaagccgtacggcagagctccaatccgatatggaaataaagcaggcggaagcacaaaagaaatcggccatcgggcaaaataacgctgccaaagaggttgccgaaagcaatgcggaactggaagttaccaaggcggaagcctctagaaaagccggtgaagcacaagcccggacacaagctgccgtcctcaccgcacaggaaaacgcacagcgtgaaatagaagaagcgaaagcccgcaaagtggaacaggccttgaaagcggataagattgttcctgccgaaatagccaaacagcaggccatcttggatgcggacgcattggccgagcaaataaaacgtaaggcaaatgcagaagcggaagctatcctggccaaagcacaggcggaagccaaggccatccagatgaaactggaagcagaagcggaaggcaagaagaaatccttgctggccgaagcggaaggtttcgaggccatggtgaaggctgccgagcgcaatcccgaaatcgccatccaatacaagatggttgaccaatggaaggaaatcgcttcggaacaggttaaggcatttgaacatatccaactgggaaatgttactgtatttgacggtggcaacggcacaacgtccaatttcttgcagaatgtggtcagcaaagtggctcccgcactgggtattctagacaagcttcccattcatgatacctatcagaacattgtcaatccttcctcgaaaggaaatgcacagaataaacctgagaaagaggattttgaaccggtagacaaggacggaaagaaacgcccgaccgacacccctcctgctccggacaagaaataacaggaaatagtttactttaagaatagcgtttgtatgatgtggcggcagaaacagatttctgccgccacacattctttttaaccgtattatcaccgctttacagagtaaaattcgtaattttgcaatcggtaaaaagaaataaatcaatggattttaagtacgacgttattgtaataggcgccggacacgcaggctgtgaagcagccgcggccgcagccaatatgggttcgaagacctgcctgattaccatggatatgaacaaaatcgggcaaatgagttgtaaccctgccgtaggtggcatcgccaagggacaaatcgtaagagagatagacgcattaggtggctacatgggactggttacagaccgtacagccatacagttccgtatgctcaaccgctccaaaggtcccgctatgtggagcccccgcgcccaatgtgaccgcggcaagtttatctgggcatggcgcgagattctggagaatactcccaatctgcacatttggcaagataccgtagaagaactaatcgtggaaaacggcgaagcgaccggagtcatgacttgctggggagtgactttccatgctaaatgtatcgtgctcaccgcaggaaccttcctgaacggactgatgcacatcgggcataaacaactggcaggaggacgcatggccgaacctgcctcctaccatctgaccgaatcaatcacccgccagggaatcaccgccggacgcatgaagaccggtacgcctgtccgcatagacgggcgcagcgtacactacgacctgatggaaacacaggacggagaaaacgacttccatcgcttttcgttcatgagcgaaccgcgcaaactgaaacaactgcaatgctggacctgctttaccaacgaagaggtacacgagatactacggaaaggtctgcccgactctccccttttcaacggacaaatccaaagcatcggaccgcgttattgtcccagtatagaaaccaaaatcgtaaccttccccgacaagccgcaacatcagcttttcctggaacccgaaggagaaaccacacaggaactttacctgaacgggttctcttcttcactgcccatggacatacagttggcggcattgaagaaagtacccgcatttaaggacttggtagtctatcgtccgggatacgccatcgaatatgattacttcgaccccacccaactgaaacatacgttggaatcgaaaataatcaagaacctgttccttgccggacaagtaaacggaactaccggttacgaagaagcaggcggacagggaatcattgccggcatcaacgcacacatcaattgccacggtggcgaaccgttcacactgggacgggacgaggcctacatcggtgtcttgattgacgatctggttacaaaaggtgtggacgaaccttatcgtatgttcacctcccgtgccgaataccgcatcctgctccgacaagacgatgcagatatgcgccttaccgaacgcgcctacaagctgggactggtaaaacaagaccgttacgaacatctttgcagcaaacgggaagccgtgagccgaatcatcgactttgccaaaaccttctccatcaaagccgcattaatcaatgatgctttggaaagtttaggtactgcccgtctgacacacggctgcaaactaatcgacctgctgaaccgtccgcagattactatcgaaaatatagccgggcacattccggctttcaaagccctgctggaccaaatcaccgaccgtaaagaagaagtgattgaagccgccgaagtgctgatcaaataccaaggatacattgaccgcgaacgaatgatcgccgacaagatacatcgcctggaagccatccgcatcaaaggcaagttcgactacaactcattgaactcgctctctaccgaagcccggcagaaactgatgaagatagatcccgagactttggcgcaagccagccgcataccgggcatctctcctagcgacatcaatgtcttactagtcctgctgggacggtgaaacaaggtatgtttcacgtgaaacaagtaatttaatagactaacaataaaatactggttatgagcaaagaaacgcttaaagcaaacttaagagaaattccagatttccccattccgggaattctgttttacgatgtgacaaccctgttcaaaaaccccgaatgcttgcaggaaatactagatactctatacgagatgtacaaggacaaaggcatcaccaaagtagtaggaattgaatcgcgtggcttcattatgggtggtgcgctggcggcacggttaggtgccggattcgtgatggcacgcaagccgggcaaacttcccgcagaagtagtagaggaaacatacgcaaaagagtatggaaccgacaccattcagatacataaagacgccatcgatgagaacgacgtggttctgctgcacgatgatttattggctaccggcggaaccatggcggccactcatcgcttggtacaaagatgtggcgccaaaaagattttcatcaatttcattatcgaactgggaggtctgaacggcagaaaggcattccccgaagatatcacggtggatacactgcttactttatagtgtcacacaacatgtccgtcaaaacgggccccatcatcgttcacaataaaaagagatctatggaatgagatggacgatgaaaccgaaagatatatatcttcaggctgtaagatatataatgttacagcttgaagatatataatgttacaaccgaaagatataggatgttgcggttgcaacatcaactcaagaaacagttctgccaaccggcaatattcaataagcatgtatggaaaaagaagagattacaaccaatgattatctgaaaggaattgtactaaacctgcccgacagccccggcatttaccaatacttgaactccgaaggaaccattatctacgttggaaaggcaaaaaacctgaagcgcagagtctcttcttattttaatagagaacaccccaacggcaagacacgattgctggtcagcaaaattgcagatatccgttatatcgtggtaaaaacagaagaagacgctcttttactcgaaaacaacctgataaagaaatacaagccacgttacaatgtattgctgaaagatgacaagacttacccctctatttgtgtaagcaacgaatatttcccacgtatcttcaaaacccggcaagtcatccgcaacgggtcctcttattatggtccgtacagtcacatgccctccatgcttgccgtgatggacttgatcaaaaagctctaccccatccgtacctgcaaactcaatctaagtcccgaaaacattcgcgccggcaagttcaacgtatgtctggaatatcacataaagaactgcaaagggccctgcatcgggcagcagtcacacgaggaatacatgaagaatatcggtgaaatcaaaaatattctgaaaggagatacccagattgtaagtgacctgctgatggaagagatgcaagcgcttgctgccgaaatgaaatttgaggaagcacagaaaataaaagagaaatatgacttgatagaaaactatcgttccaagagcgaagtcgttaattccatcattcataatgtggatgtgttctccattgaaatggaagaaaattcagcctatatcaactatctgcatatcacaaacggatgcatcaaccaagccttcaccttcgaatacaagaaacgtctgaacgaaacgaaagaagaacttctacaattgggcattattgagatgcgtgaacgatataagagcacttcccgcgaaatcatcgtaccttttgaactggatatggagatgaacaatgtatcctttaccgttccccaacgaggagaaaagaagcatttgctggatctttccgtaatgaacgtgaaacagtataaagtggaccgcttgaaacaggcggaaaagttgaatcctgaacaaagaagcgtccgtctgatgaaagaaatccaggagcagctgcacatgaaaaaactaccgaaccacatcgaatgtttcgataattccaatattcaaggctcggacgcggtggccgcctgcgtcgttttcaaaaaggcgaaaccaagcaagaaggagtaccggaaatacatcatcaagactgtgaccggacccgacgattacgcctcgatgaaagaggtggtacgccgccggtatagccgtgccatagaggaaggttcccccttgcccgacctcatcattaccgacggtggaaaggggcaaatggaagtggtgagagaagtgatagaggacgaacttcatctggatatccccatagccggactggccaaagaccgcaagcaccgtacctcggaattgttatacggattccctccgctgaccatcggtgtgaagcaaagcactcccttgttccatctgttggaaaacatacagaacgaggtacaccgcttcgccatcaccttccaccgggacaaacgaagcaagagtcaggtggcgtccgctttggacaatatcaagggaataggcgaaaaaagaaagaccgccctgctgaaaacattcaaaagcgtcagccgcatcaggcaagcctcactggaagagattgcagccgtggtaggtgaagcagccgctaaaaatatcaaagaaaatctcacagaataaaagggatttcctacctttgcatacatctactacagggacatgctctgcctcgtatcggtccaggcaagaagccggcaacatattgtccattgtagaagcggaaacattaccgataaacaactagaatttttctaacaagaaattaaagaatataaatatgagagtagttattcaacgagtaagccacgcctctgttaccatagaaggcgtatgcaaatcggcgataaaagaaggattcatgatattggttggcattgaagaagctgatacacaagaagatgccgactggttatgcaaaaaaataataggattgagagtcttcgacgatgaaaatggagtcatgaataaatctatcctagaggtaggaggcaacatattggtgatcagccaattcacactacacgcatctacaaaaaaaggcaaccgtccctcctatatccgtgctgcaaagcacgatgtagccatccccctctacaattatttctgccaagaactgagcatcggtctgggcaaagaagtaggaaccggagaattcggagcagacatgaaagttgaacttctgaacaacggtcctgttactatatgtatggacaccaaaaacaaggaataatgacactggaagaagcacaaaaagaagtggaccgctggattaaaacgtatggtgtacgttacttcagcgaactgaccaatatggtcgttctgaccgaggaagtaggcgaactggcacgtgtgatggcacgcaaatacggagatcagtctttcaagcaaggagagaaagacaaccttgccgatgaaatggcagatgtactgtgggtccttatctgtctggccaaccagaccggagtaaacctgaccgaagccttccgtcaaaacttggagaagaaaacaaatagagataaagacagacataaaaacaatcccaaattataaagaattatggaacataatcacgaattcgaaggtggacatgaacatcgtcatgaccacgatcatggacctgagcacagcaagtacgaagaagcacttgccaagtataacatccgtttgcacgatgaggatgtaaaagcgaaaactgccctactcatcgaaaaacatgtagcagaaaacaatacaccggatgtaaagaaattcctgttccattgcattgacctaaccactttaaagtgtactgattcagatgaaagtgtaatgaaattcaccggaaaagtaaatgaatttgttgacaagtaccccgatctggacaatgtagccgcaatctgtgtatatcctaatatggcagaagtagtcaacgacaccttggaagcagatcatgtaaacatagcctgtgtatcgggcggttttccctcctcgcaaacctttaccgaagtaaaggtagccgaaacagccatggctctccataccggagccgatgagatagatatcgttatcccggtaggcaagttcctgagtggggattacgaaggaatgtgtgatgaaatagaagaattaaaagctgtatgtggtgagcatcacctgaaagtgatcttggaaaccggagcactgggaagcgcatccaacatcaaaaaagcgtccattctatcgatgtattccggagccgatttcatcaaaacctctaccggaaaggaaaaccccgccgctactcctgaagctgccttggtgatgtgcgaggctatcaaagaatactatatgacaacaggccgcaaagtaggattcaaacccgccggaggaattaataccgtacacgatgctttggtttactataccattgtaaaagaagtgttaggtgaagaatggctgacaaacgagttattccgcttaggaacaagccgcctggccaatctgcttctctcagaaattgtaggccaagaaaccaagttcttctaaacaaagaactgtttcactatttaaataacaaccacatttaaagtgaccggaatgagccttatctattccggttattttaaactaccaaagaaaggcgtacctcaaaaagttcgggcgtggtccttattgtataaaggaccacgcccgaactttttgaggtacatatcttcaacaatcgtactatttatctctttcaatcacataatcaatataagcagtcaaagcatcttttacagcttgaccggctgattgtggaagtaaagccaacgctttattacgataatccaccattgcctgcctggcatactctatccctcccttcaccttagtatattcgatgaaacgggcaatatcttcatccgaagcgtctaatgcccggatgcgtagcgccagtttccgcatctcctcatcatcaaacatattcaacacatacaaagccggcaatgtcagcttcccttcacgcatatcgttcccggtaggtttacctatctcatcagaagaataatagtcgaaaatatcatcctttatctggaaagcaataccaatcatttcgccaaacagacgagcatttttcaccatttcatcggatgcatgcaccgaaatagcccccgcttccgcactggcagtaaacaatgcagccgtctttttacgaatgacatcataatacacttcttccgagaactcagaagcattaatattcgccaattgaataatctcgccttcagataagttctgtcccaaacaagccaccaaatctacaattgtaatctcgcgggtcatggcagaatgcttcaggctggttgccagcatatagtcgcctaccagaaccgacaccttattattatagatagcatttaccgaagactgcccacggcgcttgtcactctcatccaccacatcatcgtgcaccaggctggccgtatggagcaactccaatgaaagagccgcatgaagcgtagaatcattgatttcaccgaataatttagcaatcaacaacgccaatatgggacgcatcatcttgccatttctctgcttaatataggataacacctcactaagtaaagaattggaactttggagcgaagagtcaaacaaccttctaaattcctcaaactccttgtcaataggcaatttgatttgctgtaatttgtccatgcaggttaatttgtgcacaaaagtagtaataaaagacggaatacggtatttttttgtacttttacaatgaaaaaactaaagatttttaagaatggacaaactttttctattagatgcttatgcattaatataccgtgcgtattacgctttcatcaaaagcccgcgtattaactccaagggtttcaacacttcagccgtactgggatttgtcaatacactggaagaggtcttgaagaaagaaaatcctacgcacatcggtgtggcatttgatcccgccggtcccaccttccggcacgaagcctatgaacagtataaggcacaacgtgaagaaacacccgaagtaatccgtttgtccgtacccattataaaggatattatacgggcctaccgtattcctattctggaagtaccgggatacgaggccgacgacgtgatcggtacactggccaccgaagccggcaaacgggggatcactacttatatgatgacaccggacaaagactatggccaactggtgggcggaaatgttttcatgtaccgtcccaagcatacaggcggttttgaagtgatgggaatagaagaggtaaaggcaaagttcgatatccagtcacccgcacaagtcattgatatgctgggactgatgggcgatagttccgacaacattcccggttgtccgggcgtgggcgagaaaacagcacaaaagttaatcgcgcaatatggcagcatcgagaacctcctctcccactctgccgaactgaaaggagccttgaagaccaaagtggaaactaaccggaaaatgattgagttctccaagtttctggcaactatcaagattgatgtccccatcgctttgaacatggacgaactgaaaagagaagaaccgaatgaagaggaactacggaagatttttgaagagatggagttccgtaccctcatcgaccgcgttttcaaccgaaacaagaaatccgccttcgccggaacataccccgatgcgaccggaaacgacccgcaaggacgaaaccgtacactgggaggaagcgcccggcagggaaatacgccgaacggttcgggacaactctcccttttcggcgaaccagcttcgaacggtgaatcacccgcttccccgtcttctcctcaaagcaatctctttgcagaatttaccgacggagggacggaaagtgagaaatattcgaatctagcatgtttagataatttaaaatacgactatcaactcgttgatacagaagagaaaagaactgaattattacaaaacttacttacaaaagaaattttcagtctagacacagaaacaacaggaaccgatcccatcaccgcagaactcgtgggaatgagcttcagctatgccgaaaatcaagcattttatgttcctgtacctgccgatcgggctgaagcgcaaaaaatagttaatgagttccggctggctttcgaaaaagaaggagtattgaaagtagggcaaaatataaaatacgatatgctggtactgggcaactacggaaccgaagtgcgcggtcccctgttcgataccatggtggcacattatgtactacaaccggaattgcgtcacaacatggactaccttgccgaaatctacctgcattatcagactatccacatcgaagaactgattggtcctaaaggcaaaggtcaaaagaatatgcgcgacctctcccccgaagctatctataagtacgcatgcgaggatgctgatgtcacactgaaattgaaaaacatcttggaacaggaattgaaaaccaacgatgcggaaaaactcttctacgaaatagaaatgcccctggtacccgtacttacttatatggaacgcaacggtgtacgtgtagacactgaagccttaaaacagacctcggaacatttcaccgcccgcatgaaccaaatagaagaagaagtgcaccaactggcaggtacggatttcaacatagcttcacccaaacaggtaggtgaagtgctttttgacaaactgcgcatcgtggagaaggccaagaaaaccaaaaccggacaatatgtcaccagtgaagaagtattggaaagtctgcgaggaaaacacgaaatagtaggcaagatattggaacaccgcggtctgaagaagcttctcggtacttatattgatgctctgcccctattgattaataaagaaacaggtaaaattcatacttcgttcaatcaaacggtcactgctaccggccggctcagttccagcaacccgaaccttcagaacatccctatccgcaacgaagacggcaaggaaatccgtaaggctttcatccccgatgatggctgcgaatttttctccgccgactattcacagattgagctacgcattatggcacaccttagcggagatgccaatatgatagaggctttcaaggaaggagatgacattcatgccgccaccgcagcaaaagtatataagataagtatagacaaagttacccgcgaacaacgcagtaaagcaaaaacagctaatttcggtatcatctacggcatcagcgtattcggactggcagaacgtatgaatgtagaccgcaaagaggcaaaagaactaatagacggctacttcgaaacttatccccaaataaaggaatatatggacaaaagcattgaccttgcccgcggacaaggatatattgaaaccatattcggccgtaaacgatatcttccggatatcaattccagaaattcggttgtgcgcggatatgccgaacggaatgccatcaatgctcctatccaaggaagtgcagccgatattatcaaggtagctatggtacgcatataccagcgctttcaatctgaaagtataaagtccaaaatgatacttcaggtacatgatgagttaaatttcagcgttctacccgaagaaaaggaaaaagtacagaagattgtgattgaagagatggaaaatgcctaccgtatgcaagtacctttacgcgcagactgcggttggggaagcaactggcttgaagcgcattaaagcatacataaaccaactattagcaagatagatagtactatatgtaaagtatttatatcataaaagctcaatggtattttccaatccattgagcttttcatttaccatcccaaacataaatggaaaacacaaagacaagacaattataacaaataccccttatgcaattcttaatatttgtttaatcagtgacattttgcaaaaatatcatcattttctagtagaaatgttaggagattcaattttatttcgtacatttgcaccgcttttaaaaacaatatgaaagtaacaatctaatatatcaatatcatgaagaagatcaattttttgaaaggaatgctcgttgtagcaattttatttattgctaaccttacagtttttgcaggaaatccgggtgacaacctgatttacaatgcagaagaagtaaatggagtagttgtttcggaaacgatttttaaaatggaaggcaccatgcttactaattatatgaaacacaattacaagtatgacgccaacaaccaacgtactgaggacgaggcgcaaaaatggaacagtaacaaaaaccgctgggaaaataacctctgcattcgttatacttatggcaataaaagtatgactactgaatattacaaatggaactctaaaaagaaagaatatatattagtacccgaaatgaccgtaactatggacaaataaatctattctaacaatctaacacttttcataaaaactcgacgaaagggcagccgtgacggttgccctttctgtttcgtaacaagcctcccccttttcgcatataaaaaagccaaatctgacttcaatatgaagtctgatacaaaaagaatggttatctttgcaaacaaatagatagataataatcaaaaaaacaaatagataatggctttacaatgtggtattgtcggtcttccaaacgtaggaaagtcgacactttttaattgtttatcgaatgcaaaggctcaagcagccaacttccctttctgtaccatcgaaccgaatgtaggtgtcatcaccgttcctgatgaacgcctgaccaaacttgccgaactggttcatccgggacgtatcgttcccactactgtagaaattgttgacattgcaggacttgtaaaaggggctagcaaaggtgaagggctgggaaacaagtttctggcaaatatccgtgaaacagatgctatcctgcacgtactccgttgttttgacgatgaaaatgtaactcatgtagacggtagtgtagatccggtacgtgacaaagaaatcattgacaccgaactccagctgaaagatttggaaaccattgaaagccgtattcaaaaagtacaaaaacaggcacagacgggcggtgacaaacaagcaaaacaaatgtacgacatccttgttaaatataaagacgcattggaacaaggcaaatctgcgcgtaccgtacaatttgacagcaaagacgaacaaaaaatcgcaaaagaactgttcttgctgaccagcaaaccagtgatgtacgtatgcaacgtggacgaagcaagtgctgctaccggcaataaatatgtagaacaagtacgcgaagccgtaaaagaagaaaatgcagaaattctggtcgtagccgccaaaaccgaagccgatatcgcagaacttgaaacctatgaagaccgccagatgttccttcaggaagtcggtctgaaagaatcaggtgtaaaccgtctgatcaaatcggcttatcacctgctggaactggaaaccttcatcaccgccggagaaatggaagtaaaagcctggacctatcgtaaaggatggaaagccccccaatgtgcaggagtcatccacaccgatttcgagaaaggatttatccgtgccgaggtaatcaagtacgaagactacattaaatatggttcggaagccgccgtgaaagaggctggaaaaatgggcgtggaaggtaaagaatacgtagtacaggacggtgacatcatgcacttccgtttcaatgtataaggtaaatcaaaacgcaaaagacttgtcatgcaatgcatgaaaaaacatcaggaaaccagcaaaactgatggcagaccgataagtcagtgttttgtttcctaaaacaaaatacaactaacatggaaaaatatttaatcgtgggaaccggcggcgttggaggaagcatcgccggtttccttgctttagcaggaaaagacgtaacatgcattgcccgtggcaagcatctggaagccattcgtgaaaaagggcttcacctaagatcagacttaaaaggtaatcactttctacctatacaagcctgcacagccgaggaatacaacgagaaggccaacgtaatttttgtatgcgtgaagggctattccctggattccatcaaagatctgttggaaaaagcctcggataaagataccttgattatccccatcctgaatgtttacggtacaggtccccgcatcgggcaactcgttccacatgtaacagtattggacggatgcatctacatcgtaggtttcgtttccggaccgggtgaaatcacacaaatgggcaaaatattccggctggttttcggtgcacgtccccaacagggtgtggctccggaacgtctggaaaccattgccgatgtactaagaaaagcagggatcaaagccgatatttcggatgatatcaatcgcgacaccttcatcaaatggtcattcatctcagctatggcctgcacaggtgcctaccatgatgtcccgatgggtcctctgcaacatcccggagcagaacgcgacactttcatcggtctgtccaaggaaagttctgaaataggccgcaaaatgggaattacctatgcggaagacccgataggatacaacttaaaagtgattgacaaattagacccggacagtaccgcatccatgcaaaaagatatagccaaaggacacgagtccgaaatacaaggactattgtttgatatgatcgcactgggcgaaaagatggatgtggatatgcccacttaccgcaaagttgcacaaaaattcaagatatgaatacactgtcagccattctttggaatcccgatatagaaatcttttccattttcggcatttccatccgttattactccgtattgttcgttacagggctttcattggcctactgggtgatatacaaactctaccaagaccaaaaaattccttacgaaaaatttgattccctgttcgtttactgcctgctgggtattgttatcggtgctcgcttgggacattgtctgttctatgagccaggctattggctctctcaccctgtagaaatgctgttgcccgtcaagattaccgattctgggataaaatggaccggttatcaaggtcttgccagccatggaggaaccatcggactaatgctcgccttatggatctattcacgccgtgtaaaattgaagttcctgactgtactagacaatatagccatcgccaccccgctggcaggttgttttatccgtttaggtaacctgatgaatggtgaaatagtaggtacggtaactcatgttccttgggcgttcatttttccgcacgaagatatgcaaccccgccacccggcacaactctacgaagccatcgcctatcttctgatttttatcataggcttgcggttgtataaaaagtacaaaaccacgctataccccggtttctatttcggctactgcctcactaccatattcaccttccgcttccttgtggagtttataaaagccagccaggaagcctttgaagacagtatgatgctgaacatggggcaatggctcagcattccgttcatactgctgggagcgcacttcatgtaccattcttttaaacccgtaaaataaatgaaacatataatagatattgaaacctgggaacgccgggacaattataattttttccgcaacttccataattcatggatatccattaccagtgaagtggattgcactgaagcatttccagctgcaaaagccgccaagcgctcttttttcctgtattacctgtatgctgtgctacgtgctgccaatgaagtgaaagaattccgtttccgtacagataaaaacggacaggtggtctatcacgatcaggtggacatcatatcacctatcgctgtacccggcaagactttctacacagtccgcatcccttaccatgcagattttgaacggttttatgccgaagcatatcacatcgtccataacatccccgaagagggtgacccgtatggagccgaaaaagtcattaaagaacagggagattttgatattatccaactgagtgccacgcctcagctttatttcacttcactcacctatacacaaatggctcccgaccatccattagactatccgctgatgaatgccggcaaagtagtgccacgcgaaggaagactggtaatgcccatcgctttcactgtaaaccatgcttttgtggacggagcgcacataggacaactctttcagaaaatagaggagatattgaaagagctggctcaataaatagagggatctcaaaaggcataaagatccctgtcggacacgtatgtatgcatttccctacatatacgttcacatatatccataaaagaataaataaccagaaaaagaagacaatctgtcaaaatgccgatgcacgagaatacgatgaaaatacacaaactgtatcctttaaaacaggacaccctcatacaccggcattatcattttgacagattgccagtttaattaaatcagtttagaaacgatagcctacggagaactggaaagttgaattccgcaaaccattttgtgcctgtatcttttttattccgaccctataatcaaaacttatcgtataatgatcggcaataacagccttcattccaacaatgcccccataatcccaacggcggaaagcctgaagattaccactattattgggctccccggctttataggaaaaaccatccaagggcttccattttgcaggctcggtagttatattatccccctcttggtgaataacatccaaagaacagtttccagcaccaaatccgtaagaagcataaactccaaccgacggaatgaggctgagtttatccgaaacccgaatattatatcccatttttaacggcaaaatcagattattcatctttatctctgtcttaggaaaataagtaaccatgtgatccatcattttcatggtacttctattctgcaaccaagacaaaccggacattaacatccaatgctttcctatctcgtagtccacagtcacccccaattgaaagccgggcttcattccacctacctgttcggctttatatccgtcagaaccggaaaccagataatgagacaggttcattccaccttccacaccaacttttacctgtgcagacaaaggcaatacacacatggcagccaacaccaccactacaatcattttagtcttcatacttatttttttatttgatgttgcaaaattagaaagaagatataagcataaagctctatccatataacatccactcacctatacaacactaaaaatcaaccatataacatattttatcataacatgagcaataaaataagattcagatatgaacttcacattatcaataaccttagattatcaactaaaatattatcatacagccttaattggaattacttaaaaacttaaatttatctgagtcgagttagcacttcctttatcacatttaggaaatacagctgttttttcaaatgcgttatccataactacaccttttcattaccatccttatctagcatagtaatgtcagcatcatctaatgaaaattgaaatgtgagatacaagcagtcatttatatcttcggcttgtactgaaaaaataaaaggaattctagtagccaccttttcataaactttgcaaactgcatgaggcttcttttggtgatgctccgaagcaaaaactcccaaactcaaggaaactaaaaataacatcaataataactttgctttcatacttctttttgtttaaaaatgatgccgcaaagttagagggaaaggaaagaacgtacaactatttgctgtgacataatatttctataaaacactgataaacaatatatttcagtttatcactctgacattttcttttttagacgcgatttcctttgattgagggctaccgtatccgtatgtccgaaacataaagaaatggccaacggagaaatacccgcttcttgcaggcaaaggaccaacaagtcatcctccgtcagttgggagtattgtgcttgcaaaggagaaatataatcagcatagatttcaaaggtcgttttcttcagtttgtccaattcagcagctgccatcaccttacggattttcttattcacctgctgctggtcagacaatgacatcacctttttgtatatagaagtctgctgaaataaccatgtacgaagtgccaacttttctttcttcaattgagttatcaattgctctttttgggcaatttcatcaagattttggttttccctatcctgtaacagtgcaagagcggattcattttcttctatgcgctgctgcatcacattctgtttctcatcagcatattgtaatgcttgccgatagagtgcctgctggttatttttcttatttatccaacgttggtaaatcaaagcaacgacaaagcaaataataacggatacaaagacaatccatcttataatccttttggattttatctgttcatcctttactcttaattccgtctgatgtttatagactaaatgttgcacttccgtcaatagctcactgttatctaatgagtcctgaaccataacaaacgtatccagatagtgataggcagacttaaaatttcctagttcagcctccattacggcaagtgaccagtagggtatagagcgggatggagaaagaaacaaactcttttctaaataatggcgtgctgaatcatattgttccaaatcaacatataaatcccccatattataataagcatctgcttttccattcccataagataaatgctgtaaaaccttatgcgcataaacaacagccgaatcgacattttcaaagtgtctataacaaatgctcaaattatgccaagaagtaagtatcatgcttctatctttagaacgcatggcatacttcacagctttgcgctgataggttatggcagaatcctgcatatttctcatgccataaatatatcctatattaatataagcaatggcagtatctttagcatcaaaagaataatgaagagattggtgcaacacctccagtgccttgtcattcaatccacaattcccataccacaatcccagcgcactataaattaatcttctatattttgtatctaccggataatcctgcaatatttccaatgccttcaaattcatctctatcgctgccttttcatcatccatctctgccagcagccttcccttatacatcaatgccacagccttctccctatcatcatctccataataatccaaggcgaaattcaataaggaatcgcaaggcaataagggtagtttgttcttgtccgtagcctcagccagcaacaaagcatagtatgccttgtctacttccggcaaatcctctaaaacagatatattttttaaaatagtcaatgcactgtccggcttcatttccaacaatgaatctacttgctgtaacatcggattggaagaatggtggttacaggcaaataaacagacagccagcaaactgacgaaatttaaatatataataaatgaacgcatagtgattttatcttttagctttctatgcacaaagatagcaaaatgcctttataacctgatatacaaacatctattaaaaaaacattatgcaaattctgtaacacacagttattccatcttacttttcatacgatatttgcgttgcgctacaatctgtgcatcattattaccaaagcataaagcgatggcaaaaggagataaatccgccaattgcagacatagcaaaaggacatcatcttcgttcaacttgggataccgggtatgcagttgctctatgtaatcagcataaatctgtcctataatcactctgagttggcgttgctcagcattggtgagcactgcaatacgctctttgtgatgcttttgctggttggccagtttgtctattttcgtatagagggcactttgccggaacaaccagttgcgcaatttctccttctccatcttcatggcctctatagcccgttccttctcttctatttcctcgacacggctttcttgtttctgtttcaattcggctatcacctcttcatgttgagcaatattctgctgcatatccatcaggttctgtttcagcttctgcaacagatatttatagttggattgctgtatcttcttgttcttcagtatctgttgataaataatcacaatgaccagcagcaacaccacagctatcatcgcaatggtgtatatcctccgtttagccttgaactgttctttccttacttgcgcgtcggcattccaacgataggtcttcttctccagttccgtagccacattggtggaatagatagaatcttccaactgggtgctgatttccagatattccaaagctttctccacatttccctgctgcttggctatggcatacaagtcaaagaaagagagataccggatatgaatatcgacagcttccttgcttcggttcaaataataaagagccgaatcaagctgcccgttattataataaaattcccctagattccaaagacactgcaagctgtcttctctaagacgacaggcatcgtatgcccttttcagacaaataatagctatactgttccgtcctgtacgtccgcataaatcccctatatttccataaagagaatgcaaaaggaaactatcagtagaaagagaaagctgcaaagcgcgttgctggcagataaaagcggagtctatatttccatacccaatgtaagctacccccagattgctgagtgaactgatgaaatgacggttatgccgtgccagcgaatcattataacaagccttgacatacatatctttggcctgtgcgtacaagttctgtttgccatacagcccacccaacatattatatacaaaccctttccaatagaattcgcatggataggcggaaagaatttcaagcgccatacggtaactcttcagggcatcggcatagttttccatttcctgttgcactttacccttatacagaagagctatggcatgttctttggcttcttcatgatatacatggagagcaaaattcaataatgagtcacaaggaagcagtgaataaccatttttatccgcagcctcagccagcagcaaagcgtaaccggccttgtcttccgggctcataccggttagggaagagatggatttcaataatgaaaacgcactgtcggaatgttcttccatcaagtatccggcttgccgcaaagcaggatgttccgtgcgctgcaaagtacaggaaagaccaagccaacatagaaggcaaacaatacccaactgttttatataaacatacatgcaactctatttttattctccggtgacaaagatacagaaaactcagaacttatatcctacaccggccgataaactgacactccgcccgaaaggtctcttacgaagagaacacttaccatcgatagtgtaaatgaaatgctcggattccaatgaaaccccggcccttccgccgtaagtaaaatgatctggaaaatcctgatgccaccagcccaaacttgtagatactaattgaaaagtgcgctgtattctaattgaaaagagctccatccattggcaatgataaaggaaggcagatcctactcgatactgaccgaccagctcggaacgccgacggaggcatacgatgccgagggcaacgaggtgtggagccgggtgctcgacatggacgggaacgtcatcgaggagacaggcaacaagggaatggtgccgttcctgttccagggacagtattatgactgtgagacaggactggcatacaacaggttcaggtactactcgccgaagatgggtatgtatgtgtcacaagatccaatcagattgactggcagaatcctaaatttgtatgggtatgtttgtaatacaacctatctttgtgatccatttggcttagtttaccagagtcataatcatggagatgtaaatgatagtgtaacaattttacgtcgccaaaatataagaaattatcaaatagaagtgcatgttgacagtcatggtccacatatacatcttgatagaggaactcggcaagaacgatatataaatatatcaggaatgtctaacgagcaagcacttagagaactacccaataaattaagacgtgaatcttctgtaagtgctgctattaataatgcattaaattattagctatgactataactgaaaaaatatcaatcaattataataaatggggctgtcctattttagaaaaaaacagcaagtgctatctttcatttaccagtgataacgcaaataatattacaatcaaaggaaatgaagaaggtttaagactcttagcaaaggccattattggcttaattaactctcaatctaataatggctttcacattcatttagatgaaatttatgatatcaataaggaaaacaagaatttcattattgatttagtaagtgaaaatacggattttttttgaatttattcaagagaggaaaaccttgttgttcgttttttaattcaatacttataatatactccaaggttagtatatttcaacttattgatagtgcagaaatgacattattagtctaatagttggaattgtcacgtattaatgtgtgatagcttggtattagtaggattatctatgatagtttaaattcactcaatttaaaggatatggaaactaaatttacatggataccattctataaagaattatccgactggctatttggaaaacagaatagacagtcagaacttatatctacactaaaagaaatcggtattaccggttttcgagatggtacagaaaaaggcaaagagattgttttggaagagatagacccgtttacattcttttcgtatctcaacaagtttcattccgatgaaagaagagtagaaatcctacaggatttaaagcataagctacattttagatgtccagaaccaacagatgtatccggtatcccgacaatacatccgatgaaagtgcatctgtttccacataaatcgacaaggaacaagtatgatataaatgtattatgggaattgttcggacaggtaaaagaagggaaagtagatgaacgactttttcaaacggcattgaacattaaaagtgtcggaaagaaaaagctcagtattgttctgttctacgttaatccggaaaaatatgttcctttggattccaacacttcatcgtatctaagaagtaagaaactgggctacacttatgatagctttgcatcatataatgagttgtcagaaaaaatagtcaagacctttggaaaacatccgtgggagatttcatacgaggcatataattatactccggagagtgattcatcaagtatcggtagtatcagaactctattcgaaaaacttgaagacgaattagaggacgatatggattaccatatcttttatcgaggacaatcagataagagtttcggattaattccctccatctatcgagagaaacttttaatccagaatgaaaatagaatatttagagatattatcgctcaaagtccggctgatttcaaaggatgcacatctacttttgaaaagttggtcaagatgcagcattattctttgccgacacgcctcttggatattactacaaatcctttggtagctctgtattttgcgtgcgagaatgatgccgttgacggaaaattgttccgattcgaagttcaaacgtcagatattaaatattttgatagcgatgctgtcagtgtcgtttctaatatcgccaaacgcccaatagatttcagtattgaatcccttcgggatttggagtgtgaagattttaataatgaaccagacatagcctatcttctgcatgaaattaagtacgagaaaccccattttcagaatgtgattgactcaaaggatattgagagagtcttttgtgtaaaaccgatgtttgacaatcctcgcataatccggcagtccggggcattcttcctttatggtatcaatggcaataaaagccaacctgcatcactcaacttcagctacaaagtgtacatcatcaataaagcgcagaagcagaagatcaggaagcagcttgaagccctcggcatagacaaatcaacgttgttcccggaagtcgaacacgtggccgagcatataaaggacaaatatcatctacctaaataacctttccctcatttaaaaaacaagccgagctattacgcagatagctcggctctcaacttgaaaagattgcatcaagtcttaatcttgtggtacatcttgaacttgcaggcatttctctactttgtataaataatacctacatttcattgttacaaatgttactattatacgagaaattacgatatgccctatgaatagaatgaggggaaagagcaatacaatcagacttataacaacaaacgggaactcaaattcagagaaaaatttataagtccaatcaaagctaacaattgcaactacaaatagcgtaataaaaaatataaatctaatgtttgaccatagatttctactatatttcctacaatcttcttgataaaggttatagcccgatataaatagctctatagctaaaactatctgagaagttactaaaatataagtttttacaagtgcttcatgttgagacccaaacatcccgatacaaaacaagcataaaaaaccgtataatccagcatataatccgatgaaaccgcaaccttccaaatcaagttggttttcatcagtcagatattttaaacggtgatatgccttttctaaataggcactatttaatatacattcattatcctcactttttagactctctgttctaatatcattagcacgagacaatacctcccgtaccgataacttcaaatctttctgatatttacgataaatttcagtcagcacatgcttgttatcaagatagtataatccaaagtcaaaagcaattataaattgtatgaatgcaagtagattaatacattctattccagacatttttctattcaagttttttagctctccattcttctccgttatgttttaatacatattcagcaacgtactgtattaaatcaaccggatggaaagaataacgcaaattccctttacgataagtaaccgataacataagttctttcttgtctttataaaacccaatagcctcattatacttgatttctaagttcttttggttttcttccaaaaagatactattggttatctttttcaaagagtctatcaactgctcaatagagattcctacaggaactctaaataaggtatgacgcaacttataatcaaacttcaactctttgtttttagattcatagtatttcttatcaacagcaataaccacaaattttcctttcccgattaattttgctacatcggtatctacttttctgcatagtaatttatccccattagagatgtcttcgggtgacatagaggagccttcaacagtaaatattaagggattctcagattgtttatactcagaaatgtctaacattgaattttcacacggaatcctatctggtaacatttcaagacctttcaacggagttacactcaacgtaggatctccagccgccacactcatagtaccatcggcattcataccgttggtatgcacttctctcccaaaggcaaagtgataaagattagacactaactgtttcaatttcaatatattaattaatagtatgcgtctaagcgcatatttgtgattcgcaaaattagcgttttttctcataactcgcaagtttataggggttaaacatcaataatgccatcgcataaggctcttgcctgaactgtaacaagaggattacacaacagcctcactcactaataaaacattccaccataagaacaaaaagaatgcaatgaatgattacgatttaacctcttttgttcaaaagccggtttgctttgcctgtggtgaattgaatagcaggacgagaaaagagaccatgtaggataatatttcagaagagaggatagcctgtaaacagattttcttctatttagtcggttaataaatttaattgattgtttgttatgttcaagggaaaacactatttttgcgaaatatgatatcctccttcttgtcttgaaagcggtctgactgctttaaccaaggcgaaatgtcttggttttataataaataataagatcagcatggcagaattaaaggcaaccgtgtgcttgcaaggaaaggacatagaagtgatttcatcacatattgaatttaaccgcaagacagataataaaggaaggccggtgacaaatgttattggcggacgtattactataaccgttgaatctaccagagaaactactattcttgaagcaatggtaaacagccctttcaaagcgataagcggcaaggtgatttattataacactaaggataattcaatctttcgtgtcgtggagttcaaatatgcgtatatcgtgtattataaagagatttacaatgttgacaggaaacgccaaatgtattccaccatcacattttctgcggatattattatgataggagacgcatatttaagcaatcaatggtaagaagaaacatgaaatttagttgtttggatattatcgtatcaaagaaatatcactaactttgttcattgtggatgtggtgataatggatttgcagcgtcttttactaatttcatatttaatgttcttattgctacattcctgtttcccaatggagttaaaatagaatcatgttaataacaaaggtatgaacactttaattcttgattttttaaacagctatgctgacaatcctaatcctcagtatgccgtgatgctgaaaggaaaatggggatgtggcaaaactcatcttataaaacaatggaagaagaggtttgacgagaccgcagataccgacgaggaaattacgctaaagcccatctatatttcgacctatggaatggatagcgtgaatgacatcaagacaactatagatagggaattaaatcccttcttctattcgaaaaccgggcgtttcataaagggtattttgaaattagccggtaaggtagtcttcaagacgagtatggatttgaatgacaactctaaagaggatggttcattttccgcaacactggattcattgtcgttactacaagtggaagacgacagtataaaaggtgtaaagtttctgatattcgatgacatcgaaaggtgtctgatagaaatgaaggaattgttaggcttcatcaactattttgtagagcactgtaattgtcatgttgtcgtaattggggatgaaaaccaccttgaagaacttcccaaggctgtcttgggtgagtttaaggaaaagaccataggcaaggaatttgaaatacaacccgatatagaagaagccatcgaatactttcttgacgaagtaccggtatccgattatttgaaagaaatgcgtgatttcattattgcctgttttatgtgtacaaaatccgataatttacggattttgagacaatgcttgtatgattttaaaagccacttaaacaaacttccttccgaactgattgaaaaggataatatctttcttaaaaatattcttgggtcatttattgctgtgtatgcagagtataataatagtgagaacaaagagttaatttgtaattggagtagagattgtcagatttcactactccaagatgataatgaggataagcaaaggatacagcatctaagggaaaaatatcactctttgaacaaggggttaatttataatgtcttaaatccggagtatgttacggctattatacaatatattatcacaggtgctccacttgtagaatttattgttacggaaataaaggataagcaagaagagttgaagccttgggaaatgctatccggctttttcgacatggaacagcaaaaacttgaaagtatttgccaggctactataaaagccatattggataaagagataaaagacgcttatcaacttggttatagtatcgcgtatctatcgtattttgatgctattggcattttttctgatataaagcctcatatctcttcaataaaagagagaatagcagaaatgattaatagtcaaaccagtttagaggaactttatcagctaaggggtctttttattagtggatgtaattatgtaaccacagatgtcaagactccaataacagatgatattgtgggctatttcttgcagcagatgaaatcaaagataaatgagttgccggatcaaatgcaaaaagcactgcgtaatttgactgaaggaacagtagaggaacttataattatagacagattgccttatccagataaaagttgtacatacgaacttcgtgcgatatttgcatctgaagatgccaatgctctttttgatgctatctgcaaactaagcaataaaggcagaaatgcttttacgcaatttcttgcttatcattataattttggctatgaccaacaagatgtgggagacagatataaggcagatattccttgtttactcaaactgaaagatttggtcgataatgaaatcagtatatcaaaaggagtggataaacttgccttcataaggttaaaagatgtcttgattgaagctattaggaggtgtgaaggctaaagtgatacattgatgccaatgtagaagctaaaaatggcgtattgtaaaaaacggatacgctatgaaaggccattattcctattgggctaaaatagaggatataaggactataaatggaaacgggtggcggcggggaatcgggaggctataaagggaggaaggatgccataaaagagtagagccgtcggcagaccggagcgcaaaaatccctctgcccggtcatcacgaccatgcagagggaacggttgaaattatgattatgtcaagcagcttcggcaatagcttcgtgtttggctgcctgcggttgtccggtctctttcaggctttcatcaatcctgtgttgaagttccttacactcctgtttgagccttgacagttcatcggctttactccactggcgacaaatgatgtcctgcaatgtaggaatttcgctttctatccgctctaccgccttttgttgcttctcgataagagagggcaatttgcttaatgctccatgcggatattgtgccgactcaacgaaaccaagcggcagtgcaccactcaggccgcatcggtatttcaatccacttataccctctacaaagaatgtattgcggtcaaacgtaccgtctatgctgtactcgctacgcaccaacaagttcagccctgcatacgtgccaactgtgccatacgcttcgttgcggtaggtcttggcgatacggtgcaactcccggcctacttcctcggtagtggcttgcggcaagctcaaaagcagggttgcctttgtcccattatacgagttgatgtattccaaatccctcatgagattggcctctgtacgctttgccttttcgatttctccctgaccggcagctattttacgctcggcacggatgcgttctttcttgaaaatagcctgttccttttcaagctgcataatcttgttgtcgagcttcgtcttgttcagcaagtcgttattgcctgacagaatagccacgaactcggcaaagttcataccgctgtcctcatccatgcctccctcgtcaatacggcgcacggcgattgtgccgttgttaatttggttgataaacatctgcttgtttttcaacagattaaatttataggcgtcgagggtcttttccgtaccataaattacgacatctaccacattgctaccccacagctttacggtgttgcctttgcgtattgccctgccgtttcgttgctccatgtcagcaggtcgccaaggtatttcaaggtgatgcaccgccacagccctttgctgggcgttcacacctgtgcctaacatggtcgtgcttccaaaaagaactcgcacctttccgttgttcatttcttcaaacagcttttttcttgccctctcggtagtggcgcattggataaactgtatttcatcagcaggaataccgagccgtaccaacttctctttgatgtcggtatatacgttccattcgttcggtttgtatgtaccaaggtcgctgaacacgaactgtgtaccccgattgtcattcgagcgtatatagtagtcatagattgtcctcgcacagatagaagccttgttatcggcatcatccttgaacttgcaacccaacaagcgcatatcaagagccatttttcgggctacattggtcgcaaccaacattttcgccttgtcgaggttgtcgggttgcggaacgtcaagccccaagtcctcccactggccgctaccggcgaaagataccaagcgtcctatcatttcctcctgctcgattgtcgggggataagagaggaaacgcacgttcttctcaggtacatcaagatttatcatgtcggctgtacggtaatccgtaatctcacgcagaaacattgccagctccggcactttgatgtaagtacgaaaacgctctttgcgcttcaccgagcctgtcacgttcaattcataatctgccgttttctttgtgaatatggctgcccacgcatcgaaacagctaatccgttgccgttgaagctcctgcggacgcaaatacttgaacatcacatatagttcggtcagtgcatttaccaccactgtacccgacagaaacgtagccccaaggtcacgacctgtccggcgctgaatgtcacggatggcaaacagcaggttcatcgccctttgcgagcctttggtattgccgatacctgcaaccctcgtgtggcgtgtctgaaacattaaatttttcattacatggctctcatcgacaaatatgtggtctatgcccattgtgtgaaagtccaccgcatcgtctttccgattattgattttcatgcgcagttcttgtagtttagctgcaaggttctgtttgcgcttctccagtccgtcctgcatttttccgctacggtaacgcatggtggactgctccaaaaattcgaggttacgctccacatcggcaagctcttccgtgaatatatctatcatggtctcttctgactgcggtatcttggcgaactggtcgtgcgtgagtatgatgcagtcccagttattattcttgatttttgaaaagacctcttgcctgttggcaggggtaaaatcttccttgcccggatagagaactttggccgtagggtatgccttgcggaacgtatcggcgatttcgtgtacattggctttcagcccgataataagcggcttgtgtgccaatccgagacgtttcatttcgtaggcggcaacacacattatcatcgtcttgcctgtgcctacctcgtgccaacagataccgcctccgttctgcttaatcatccagatagcatctttctgtgagggatagaggctgtcgtatggaaattgctcgaaagagagctgcggaaaggtctgtgccgaaccgtcataatgcggcctgacatagcagttgaaacgctcgttatacaccctcaccagctcgtcccgaacctctatcggctgcctgtcaagccagcggttgaaacggtctctaatctcctgtatcttggtggctgcctcttgtatggcttcctcgtccggcacacgcaccttatcaccgttgcgacatatctctttcgtgatttcaggtacagtatcatgcagggcatgaacaaacaaatccccaccgtcatagttacgaacggaataggtgttgtaagccaccggagagtaactttgcaggcgtactatgtaggtatcgtttacatcgaaatacattacgcttgtctcggtctcaaaaagttcagttgcaaaatcggcatataactttgtgtcaatccaacgctcacccatgttaatgtcaagttcctcgtagggtatcgcttcgggtgtcgcatctgccaaagcctttacagcagtttccgtccaatctttttccctgtccgtgaggtcggacaagtaagaacctatttccttgcatttggcaatgacattgcctgaaaggaacttgcctttgtgctcccactccccgataacaggattgtaaaatatctcacctttgaggtcgccgatgatttcttcctcggcactatccgtggactgcatcaggtagtccatatcaaccctgccgtagaaattcaagctacttgccaacgcttcaatcggtgtcagccgtttgttcgggtctatcttcttgaacgccacaggctcacgcatgatgtcggacttgactaaatcctttccaagctgcatttctattgtaaagacttccacaccgaggctgtcaagcatgataaactccttgttgtcgttctcgtggaaacaaccccatttggcaacaaaggtatcgtatcgggcgttcagctctccacgcaatccgttatcctctttttgttcttccctctctttgattgacaattcaaagtatgccttgcgtatagggaaatagtcttttgccctatctgcattgaccttaccctcgtccaccggtacaaaatcaatggctacctcttgataaagacttgattttcggtattggatagtacccacctgcccctcaaacagcaccattgtgccgtctttcatccatgcttccaccccgtccgtgtaggctcgtttgccttttgcgacttgtttcatggctacactcccgaaaagagacatctgcatatcttcgctaccttgtccttcccccatgaaaagacttttgcggaagtatcggccaaagtcaagtttcagcagtgcggcgagatattgtgacatggcattttcattgccctgccattggtatttgcgtacatattttccgtattggttctgtacaatgcggctacctgtcgcaagggtggttttcggtatggtgaacaatttgttggcgtattcggtcattgtgcctgtggcgtccgccttttccctgcctacttgtaaaaacagttgttcccgctgtgagagtgccgccttgcgcgtgtgcttttggaatatcagcaggtcgctgcctacctctataccgcttgtctgcatgaaaagcatatcgggcagacggattgcacttatcaggtcggcatgatttacaagatattcacgcacgaacttattaccgggcgtgtcggctatgcccctcgatgtgatgaaagctaacaaaccaccctcgttcaacaactccattgctttgacaaaaaagtagttgtgtatggtcttggtggcctgttcgtacataccgcctttcttccatagttccgcatcgaacaccctgaaattgccaaatggaatgttggaggctatgacatcgaaagttgtatgttcaaaaccttgttctccgatttcttcaaacccaatcgtccgtgtaagcgtgttttcatggagcagggaaagtatcatccccgaaatgaggtctttctcaatagcataatcatacgtgccggacatggctatgggtagaaagccgcctataccagcacttggttcgagaaatgaacgcattttgagaccgttttcgccgaacgtggcatgtatctgccgcaccactgcatcaacaaggaatttcggcgtgtaaaatgctgtcagtacagatgctttgatgccctctatgacattgtgccgcatgggttctgtgaaatgagggtaagcattgattaactcctgtaatctttgtatcggttctttcatatcaccacctatgggtttgtccgtacctatattcaatacttctttgatacccccgaaaccagaatatcgggataaaatttctttttcttccgcagtggcctgcctgccttgaacttggattttcattgccgtttctatggcttccacgttcgctaccaatgatttcaatttgttgtaactcataatttaacctttcttttttttccctttgttcggcctgtttgcgacctctgggatttatttttctgcctccaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttccctttgttcggcctgtttgcgacctctgggatttatttttctgcctccaaaaggtggcggaaacaatcgggacaaggctgatgcggaaaaatacgctcgacagacggagaggaagatttttgcggctcactcgcggcggaacgtcggcattggcaagattggagcagcctattacctttgcgggaaaataagtccacgagaggtcgcacggcagcagcaaaacgataataaatgacaatcaaatagaaagggatgaataaaactgtaaaacaggggtgttaaaacagggtaacggacaaccggaacggattgcccgtactataatcggggggaaggtgaactataaaaggaggtagaagcgtatggattggcccatctcttgataattgcagaatgacgactgtattaaatgtcgtgaaaaaaaatgcaacgggctatttttttgtatcatgagcgtattattcagcaaattagttgtatctttgtaatcgcatagattttttttgaaatgaaaacagctatacagattgccaaaataagagcggtggtactctacatcatgcagagtttcactcaaggagtggactatataaagttatttaaaatactttattttgcccaacaggaccatcttgtcaaatatggcaaagtgattgttgaagactctttcagagcattgaaacatggcccggtgccagcctatacctacaaggcactgcaaattgcagaaggcaaacccttggatgggaattttgacgagttcctttcagacatagaggttcgtgacaagaaagtatatacttctgctgtacccgatatggactatatatcaggtgccaacaaacgttgtcttgacgctgctatcgctaaatataaggatacagacccttatgacttgtccgatttgtcgcatgactcggcatgggaagaagcgatgacacgcattcaggatgatcctcaaaagaacttcattaccattatagatatagcccgagcaggaaaagctaccgaggacatggtagattatatccgagaaaagcagattgtcaagaacgctttatcttaaatcaaatggacgacaaaaccggtgcattggaaaggctgaaagctataatggccaaagctgagcaagtagatatgtcatcagtcaaaattggtgacattatttatgttcccttggacgaagaggacggactgatactaaaagacggatataaagaccgcaataaatatattgttattatcggctttactccggaaggtgtcgctatcggtgccttactgataaattcggaaatagactcttccaagaggtcggaagagctactgaactgccaatatcctttgatggttcggaactatcgtgatattctggactatgacagttggctggattgttccgatatattcgagctttcaaaattgaaaatcacggaaaagaacggtaaactgaaaggttgcttgatttccgaagacagggaacgggttatacagtttctaagagagacagaggtgttcgataatgcaactaaaaggcgttatggcattattaaataatggcgttaaatcatacaatccgaatacattaaccccaccagttatttaaaaggtgagaaaatcggttgtttgagtaaaaatgtgaatcttacaaatcgtgtagatccggacgtgcttaatgactggatgataagtcagcgattatttgattagttttccatacagaaaaatacataagtctccagtcgtaaattgggaacttatgtatttagtgggtcaaatgctgatgccgtcctgtaaaacgactggagttatcgttgtaagtgataacttcttcagacatcattaatctctactttccaatcttatacatattatcacgggagtcaaaccgcacaccgcaaaaaatgtagtcaggtgtacgtactgctcttgccgtgtatatatctttgcagttgcattcttcaaggtatcctgccaaactatccaccataatagcgcaacttaattccgctgtttgatgcttgaaccgcctgccgtttatttcgactaacacataaggggcgaaaaaatcaaatgggctattgctttcgggggataagatgccgatgtctatcagtctgacaggatttaacttttcgtcctttgccttgtcgttgtccttttcaatttgttcacgtagcaagcggagatagcaatctttcttcgcctcaaaagtatgtatcgacttaatccactcacgaatccgtttcttaaagtatgccatactattggaaacaaagagcgttatccgtccgtctatgacaaaaccgtaattggtcataccactccatttacccatacatttatggcgtacaggctcccatgtcttgcctcctacaagggcgacaaattcatctactgctgctttctctttccttttcattatatatagtttttaaaattcagaaatagttcctttctcaatcaaaacgttatcggcataatactcaatcgcaccagtcgtaacaccaatatcctgacaaactgttctgagatagttttgatagtcgtctccagaaaagttcttaccacataagtttttgaaaatcatcggaatggatatatcgtctgtacttgatagtatcactttgccattctgcctaatctctgttttcataatgctgtttttgtttttattgttactatttccctttgttcggcctgtttgcgacctctgggatttatttttctgcctccaaaaggtggcggaaacaatcgggacaaggctgatgcggaaaaatacgctcggcagacggagaggaagatttttgcggctcactcgcggcggaacgccggcattggcaagattggagcagcctattacctttgcgggaaaataagtccacgagaagtcgcacggcagcagcaaaacgataataaatgacaatcaaatagaaagggatgaataaaactgtaaaacaggggtgctaaaacagagcaacggacaaccggaacggattgcccgtactataacatctttttgataaggcaggatgcggttcggaacaggcaacctgaaaaacaatgttttttgtttgcttatccgctaatctttcgttatctttgtcaaaatgaagacagcagacggtactttcgggtacggtcattgtcgtgacatggaagattcatactcggcttggaaacaggcagagattgatatacatattgtacgttcactgaacgtcttggaatagaaaactgacacttatcaaaaagacaagatgtatagcaaaatattcatactgtatgtttatacagcaggggcttgcttatctgccttttaagtatgacagtacctctattccggaatagcgtgagttcatgctgttctttaaggtgcaaggtggacataattcttaaaaatacattgaatatgaaacagattaccttgcacgtgtatcagtccatcgacggttgtccggctccttcggacaagtattttgatgcggcagtggatgcctccagttgtgtgctgattgacgaagaaacttacctgcgtatttatatgaaccatttgggttggccgattacggcaaaagagactttggttgtgacgaacggcggcatcgacctgacggagaatgaacgagtgaagttcatccaaggagatgcagtggcagcactgcgacagatgaaggaagacggtgacggtatggtggtggcttacggtgaggaaatcggggctttactcttggataacggactggcggacgaaatcacagtgacaaccgttccggtactaatcggcggtggcgaaaaggcattggagtgcggactgaacgacggcagtgcttggattgtgcggtcaaataatgtgctgttggacggaaaaatgaggacggtgtacgggaaggtctaatatgacaaatagatattatagcaaaagtgcagcaaccgattgctgcacttttattataaaagacgtgccctaaacatgctaaataggcgaaaagtaaggtaagtatattactttttaagccgaatactaaaaaaggtagggaaaggcataaggaggatggagcctccgaagatataaaagtacagcaacaccaactaaaccggcacataggtaaagccgggcaatacatcagaaccaatagcgtactttgccatatcacgctatggctgacaaaacagcctttacatgaatggcaaaggaattaccgctacggctcagaatatgcgaaaacaagatgtctgttatacgattgaactgtcatagagatttataacttttagcccattcgctgtagccttacgataagtataaaacgtaccacccttgggcttgccgtcataccaggcaataagagacgaactgtgaaaaaccatatagtcgttgcgtcgaagcaaacagccatggtagtagtgttcgctcaggatgataacatcatccgagttacggaggatggtatcgtaccgggctttcatcgcatcgttccaccgctcggcttgtccgcgatacggtactacggcaataacttgcagaccagacaattcggactgcaacgcaagggcaacttctgccgccagcatatcaaaccccatggcacaaccacagtaaaaatgacgataacctccaacgtatgccttggttatcgctgcctttaattgcagcttcagttgcttcctatataggaatggaatattacggtgtccactgaagcaaacggacactgccttatcatactttgtctgggtcatattatttcactttgtaatgggttcttgcgaggaatatacctccgagtacattagcaccaaggctttcaagctgattggcataagtagcataactcagccctttggttatcacatcatcaaagactactacagacctgccgttgaaaaaagccgaatcaaactcaatgacgtttaccttacggacttctttctctgccttacggttctcgtgaatggtcagcctctcaccactcactgatacatggtcataaccattgatagctccggtcagttcgcataccctttggcagaatgccttgtaacgtatctcgttcttcttatcggtggatgccggtacgggagaaaatacaatgttggtgcatgatgttccataacgttcggtcatgttggctgccgtgcgttgagcaacctcttcgtatgcccgtccatccttgaaatcaaagactaacttgcggtctgctatctcacgctcgctcacattgcgtatgcgtgcaggaaaatacttacagaaccatacctgtggcttgtccaactgcttttgaagttctatgtctatcgtctttgccataactctgataatttttctttttccctctttttgaaggctgttcagcctgctgagggatattttctgccatcaactgccgcccaagaataccgataagacaaaccggggacaagaaatacgctctgacgttcagaggaagatttctcgttccagcgatagtggcgatttgatgtttggtaaaaggcggcttactttgcgggaaatatgactacgacagagctgactgacaaacagaacatgctttcttactacaagaggttgtcatatagacatgtagaataggtgcaagatttataaaaggaatgggtgggcagtggagcgtctgtggcttgccggtccaaacttcccgatgaagtgaccgtacaacttagtctcaaatctggcgaagcgtaagccttggcagtttgtgaccgaggtgtacggtcttttcatgtttggcttccgtaaagagtctttcactcaccccatagcagctctgctgccataaggtgagtgaatgtctcttgcggacaagtcctgtgacgttccgctgatggtgtggggcgaagctataaaaacagacagacggcattgccggttacaaaaggacagatggtggaggttgctgcaaggacaacaggttggcttgattgacacttgtggcaaatgtgccatcgtccttgctttgccccaaagacgggtacacagcatatagcagacttgtatgccatttgccgtgtaccggtcaaaagggcaaaaacatcctttataaaagcatgtacacttaaaagaggaagttgtatgggtaagactttataatataagagtgatatggcttacaaattatcggtgctattttagattagtgccacgattttgctaactttgcaagtgagtgaaaacggattctgataataagcaatgaagccattacatccatatccgattacgccgaaatacactgtaatgttgtaaataaccggattgaaacggactgcttcattcaaataaaaatacgatgaatgcaagactattgttcatactcctgcttttcgttatcggggcattgtggtatattatcggctactggcgacgaaaagcaggagaagcggcattcgccgccgcacggttggccgaaaagagcgaggaacgtgaacgctactgtcgtctggcggtaatggccggtcatcgggaagcctgccgtatgttctgtctcttgcaccccgaacagtttgatggccattctccccataagccgttcaaatcacgaggcatccgaatctctttttacgggtattactatccgtcacgatacaatgcgctgctcaatgatgaacagagggccttctgccattccatctaccaattcaaacaaggagatatacacggaatcgagttctttaaaacgtgcatgaatgctttgcaactgaaaaagagaccttaccatatcatgttcatgccgtgtagcaactggataaaatacggccaacggttcaaacggctcgactggtacatcggcaagcatcgacaggatttaacttcaggactgtacgacgttgatatttgcgatgcacgagaaagcctgcatgaagccaaaggtggagaaaagcgtattctcgaacgaaactacctcattaccggaaatatcaaagggaaagagattatcatcatagatgatgtgctgacaaccgggcaaagcgtggcggattacaaggaagaaatagaacggtgcggtggcaaagtagtggcggctatcttctatggcaagacgttctccatgccttcgatgctccttgtgcaaatacacatctggggcaaccacattgcccatattatcgaacggatgacaaagtaaccggaacggtttcagtcctttttacttcttttcacaaacctgccaatgctgatatacactcctgccggatggattggatataatcgagtataagcgaggggctgatactcctgccattgagcttgcaggtgatatgtaggtgttcgccagtgctgcgtcctgtggagccggtaatgccaaccacatcacgcggatgaactactgctcctttgacgataagaattttagaaaggtgacaataactgacggtgtacctgccatgccgcaaagttacatacttgccggaagtcttgtcctgtccgaccttcacgaccacaccctccatcatggccatcacctcgtcgccacgtgcgcgcaagtccagtccaccatgaaatttactctttcccgtaaatgggtccttacggtagccgtaaggcgaagtgaccttgatataacgtaacgggtaacttacactcaagtaacgatccatccactttttcttatccatatctgcggataccgggatacctgttgaaacttcctgtatggaaatctcgctttcaagtgccggttctgcttggtctaaccccatatccaatacctctatcttgtagcgtgtcggggtaacggcaacggtattgaattgtgctttggccgtcgtgatacataatgagacacctgtcatcatcaataatagaatctttctcatggcagcaaagttagcacgctcttcttatggtctttccattgccggctgttttctctccaaatataaccatttaatcagttttgaatatgatttttcgcaaataatcatattcaaaacattaaaaatatcactttataaccacttataaagaaatgttttagttatcagataagaaatcaatctatatttgctgagtataattttataacattattcagaatatgaaaaaagaacaatttgagttcaatgaactgccttatccgacattggcccgctttgggcttacccaagaaatgattgaagatttgcccctgcgtatcctgaaagaaatcgggaaaggcggctactcgccggtactgcccatgcgtgtcactaacgagaatggcgaagtaatcgagagtcgcagtcggtttgcctttatccgtatggatagcggcgaggcggatgtggtcttctatcccacactgaaatcctcaccactggaatgctacaacgaggaacagcagaaacagttgctcgacggcaaatccatcattgcagacgtggctatggcggacggacggcacagtaaggctttcgtgcaaattgacgaggaaacaaaacaggtgatgtatgttccgacacccatcattgcccgtaacctgaaagtgctggctgaagtaatgcacttcggtacagtggaagtaaacggaatgcagcatggtgagcctctgacggtggcagtggatggcgaaccggtcacagtaggcatcgaccttcataacaagactggcatccgtttctgtgcgggtgacgcgcagaaatggaaagagcaacccaagcgcgaatgggataagtacaccttcggctgctacggctgctgggtgatggatgatgacggtaatctcgactacgttccggaggaggaatacaccgaagaactgtggaacgaacagaagaaaagcggcgagcgtaaccgagcggcaggtattcacaaataaaacctatttaatataagcgtatggcacaacagaaatattatcccgaagagattctcgtcgagaagatgcagagcggcgaatacggctggctcgattacatcaaccatttttccgccgagtggcaggaggagtacgctcattactgtgaggaaaaaggactcacggtctgcgaggattctgctgccgggtttgtccgtttcaaagacgaacaattggaagcggctatgaaatacggtaacgcataacaagtaaccattataacatcagactatggcgatacgaacaaataccaatccccggcagatggacttgcagcccgaaatgcgcaatatactgatgcgtaacggacttcaagcccgtgttgcatttgacggaggcggctaccggctgattgtgcaagggcatgattcaccgttgctggtctatcctataaccgaacgccagatgttggccctgacggactggggaacaaatacggccaataagaaggcctacaacatacttacgagcatcataggaaaagacttctatatgccgaagaatttcgtccatgcccgcaatgccaacgggcgtgtggcgatggggctacatggctaccgcatcggtataggtgaatacggacacatgggacgtctgggtatgccccctccatttcttggttggacaccacgcgagcagtggggtttccacctacgcagagtcggcgggcagcttttctttccggggccatccatcgtacccgaacgcccaaacgggcgcatgaagcccggtgaactgcaatcgggtggctacggcttttactacaaaggcggtcaacaggagcaacccattgtacagcaagatgtattgaagaacttgcaggaggtcattacaccgcttgtcagccgtccgcgcagcaaggaaccggcacaaccgtacaaggagttgattgcttcaccagtctatttttccaacgagaaatggtcggagtgccttacttcgcacggtcttatcgtggatatggaacggaggacactgaccgtacaatcggaaagtgtcaatgccgatatggtctatgacctgacggaagaagaagtgaaaaaactggctaccgcatccatcgaggaacaacctgtggagaaacggctggagctgctgaatggcattatcggagcggactttgccgataaggtaacgatagaacagctcaacagcgaacaacgcatcagtatcggcctgcatcccgaagtgcggcatgaactggaagaacggcagcggcaggaacaagaattattcatgcagcaagaaactccgatacggcaggaatacatacagggcagtatcggtgcagccgtggacgggcgtgacctccaactgctcaacgaaagcaaaggctggtatcgtgaggagaaacatggccgggaagtagaagtcagcgacattgccgtgcaaccgacacagacggagggtaaatacaagatgtccgccgttattgacggacaggtcatcagccacgaaatcagccagaaagactacgacaagtttcttgctgtggatgattaccaccggatgaaacttttttcgaagattttcaacgaggtggatatgaagacacgtcctgaagcgaacaaggggcttggcgtgaagatattcgctgcccttaccgccggtgcggtggtggcgtcggaagtcgcacatggcttccatcaccaccactctccggagttctatggcgaacgtttcagcggaccgccacatccatacttcaagcccggcgtagatacaccgagagatgtggccatccgtaatttcgaggcacagatgaatcaagatattaatgaaatgagaagagggaggtaaacctatgagagatggagaccttacatacgatgacttcctgcaacgactaaacatccaggacgtattgattgacgcagggtatcacctgaaccgtcgtgacggtctgcgctatccctcgtatgtccgtttggacagcgacggcagacgtatccgtggtgacaaatttattgtgacacaacaaggaaaatgctgtttccacgcacaacaacagaaagtttataacatcatttccttcatcaaggagcatccgcactttttcacggagtaccatgcgggtatgtctccggacagactggtgaatcttgtctgtaacagattactgaacattcctgtcactgaacggaaaaccaaaatagtgaaccctaaacgagatgtaaagccatttgacatagcggactacgacattcataagttcaatccgcagaaccgggaaacgcagaaaaaattttatccttattttaaaagccgaggtatcgacctctatacacaatatgctttccatcggcatttttatctggctacgaaacaccgggaggacggtgcagcctacacgaacctgtcctttccactaaccctgcccaaaggcgacggagagattgtgggacttgaagaacgaggacgtgcacgtatggacgggagcggcagctacaaaggcaaagccgcagggagcaattcaagcgagggactgtggattgccagccctgcccgcacttctctcacctccgccaagcatatctattggttcgaaagtgcttatgatgcgatggcatattaccaacttcatcaggcagaaaataaggagttgcgaaaggcggtttttatctctaccggaggggcaccaagccagcagcaattcaaaggaacgataaaggtaactcctcatgcctcacatcacctttgcttcgatcatgaccgtgccggacaagtctatgccatccactttgctctcactcatgcaggctggaacttctccacctgtctgtcacaaaccggcagactgattgtacaggacaacagcgaaggctatccacagtatgaaataggacttgaaccattcaattttgaaaagattatatccattctgggtataaatgatgcaaaacaaaatttgaagaatggggagcatgacgatatggacattggggacggctatctacaggaaatgagaatggttcgtatggatgagtacgaaatggcctgtgccgagggttctgcaagtgaggaagaattagaggtaatgagaaataatctggtagctatcgacaaggcgattggggctttcaatcccggtccgaaagatgtaggacgtatcctgtatgaatctgccgcagaaggttataaggattggaacgaccagctactcgacaaacggatacaacccaaagaaaaggaagttgacgattgggaaatcagtggtaaagccaccctaaaccgagccttggcagatttacccgaagtcaatccagaacatatccgaaacggattatatgacgaagcagaccatgaggctgtgcgaaagcgtcttgaacgtgcagacagagtaatattttcctttgaaaccaatgaccagggaatgtcagataaaggttttcaggaaatgtacaagatacgggaagaacttgcccggttggaagtggatataaccaattctctctccggcatgagagaagactttcactcccattttcaccgataatccataaaacctatgcagagaacttatcataaaaccattgtcatccatccgcataccgggcaatttgtcatcaacgagctgcccactctcgtgctgtgcggcactgtatgggtgtacggaggcatggaaggggtgccattgacagctattgccacagtaattgccttgatgctctcgttgctgttactctaccgttatctctacctgaggcgaatccgttactgcatcggtacggaacaacttgtcagcgaatacggtattatccgtcgcaaagtggattatatggagctgtatcgtatcgtggattttcaagagcaccaaagcctgctgcaacaattttgtgggttgaaaaccgtaagcatcctttcaatggacagaaacacgccccgtcttgacctgattggtatcttccatagggacgacctcgtgtcaattatccgtgaacgggtagaaactaacaaacgaaaaaagggaatatatgaaatcacgaatcattagtctggggctggttgtctcgctggtatgcctgcttccacagatggtagaagcccaaattgcggcttccaatccgttggaatggacagcattggccgaaggtaacgaactgataaacgagcagattgaaaaacaaataaagggacagacacaaacagccttgcttcagaacagcatcgctaccgagttcaaccaaatccacaagtgggagaagcaatacaacagttacctcaagacagcaagtggttacgcttcatcactgaaagcctgtacgcatctctacaatgacggtgtgcggattttcctcacgctggggaaattaggcaaggccatccaaaacaatccgcagggcattgtggccagtatgaacatgaacaacctctatatagaaacagcaacggagcttgtctctgtttttacattgctgaatgacgctgtggccaagggtagcaacgaaaacatgcttacgggggcagaacgcagcaagacactatgggcgttgaacgaccaactatcggattttagccggaagttgcatctgctctatttgagcatacggtactatactttcaatgatgtgtggaacaacgtaacggcgggaatgcttgaccgtgacaacggtgaggcagctcgtatagctctgtcccattggcacagagcggcagctctcgtccgataaaatatatcagttatgaaatggacaatttggataagtatattgctgctgtgtcttaccggtatcggtgaggtacaagcgcagaatgaccctgtactggccggaatgattgcagcatataccgaaaaggcagagaaggaattgaaaaatcaagaaaaggtcatgctgatgcagaccaccgggcatatttggacaaaagaagaagtgcaggcgacaacagacctgcaacgagagttcaataactatctgaactctttccggtcaatagtctgctatgcggcgcaaacttatgggttctattatgaggtatcgaggctgacagacaatatgggcgacttcaccaagcaattgaagcgaagtccagccaatacgcttgccgtatccctatccacacagcgcaacaagatttaccgggaactgatgatgaacagcgtggaaattgtgaacgatatccgcacagcgtgcctttcggagaacaagatgacggaaaaagagcgtatggaaattgtctttggtatccgtccaaagctcaaaacaatgaacaaaaaactgcaacgactgaccaaagcggtaaagtacacgacaatgggcgacatttggcgggaaatcgacgagggtgcacgtcccgaagccgataaacgcagtatcgtggacgcagccaagcgacgttggcgacagattggaaagaatgtaagaccttaaaaatgtaatgatatgggaatttgggattcaatattgaaatatggcggcaaagcagcaaaagctaccggaagaagtatgggacatgctgcactgcatccttcacaaaccttacggggtacaggacaagccgtcaagaccgcagccatcggcggtgcagtcggttatgtgggttgggagaaactaaccacagataagagcgtggtacatatcgtaagcgatgcggtcatagggaaatcggctacggatacccttgcagatgcagcggacggtgtgcgagaactgacaagcaaggccggagaagcagtcggttccgtcagcggtacggtagccggcatagactcaaaactgggtggagtatcgaattttctgcggcaagtctccaatggcggagtttccgatatgttcggtaactttttccgtaatctcggacagggtaacgtgtcgggattgagtatagcaggactggtcgcagcagcatttcttatattcggacgcttcggctggctgggcaagattgccggtgcatttctcggcatgatgcttatcggcaacaatgccggtattttccgcacacctgacacgggaagcatacaacgagtacagacacccgctcttcctgttgaagaacagacgaatagcagaggaatgaaaagataagaatacgaatcaaatctaacaacaataatgaaatatacagaagaaatgatcctgcaatccgaaagtggatactgtatgccttttgaagaacggcagggcaaggatgtgaaactatcgctcggctacggcgaacaaaccgatccggcaacgggcaaaacatattttcatcatggcatcgacttcgatgtacggtgttacacgctggcggctgtcgccagcggtatcgtgtcaggtataggcaatgaccctacactcggcatctgccaaactatacgctatggggagtatgaagtgacctatgggcatttgtcaaatgtcttcgcccagttcggacagcgtgtcaaggccggacagactgtagctttgagcggtgacaagctgcatatcgggatacgcttcaaaggtgaggaactgaacccgctggaatttctaaccatgctgtatggtaatatccaagcattgtgtcatgccgatggagacgaagcgacaacatctcccggcatggcgatggcactgaccaccgattacgagcaggacagacaggaaatagaggaattgatgctgcgtttcctgccccactacatggaagacttacagcgtggtgcataccgacttcctccacatacggagcagtcactccgccatgtctttacaatgggagcagtcaaagaatacttctatgaaaatatgccgagtatatccaacccactcggactgggacataaagcaatgccgcttgcctgtaaggtgcagaacctactcattgcggacttcctgcattaccttgccctacggcatggcgtgtacttatcgacgatgggcggtgatgtaaaaaaaaactctatgacgaagccctgccccatagtggtatcattgacccactggcagaattggacatagacatccagagttttgacataccgagagcagtcacggtatatcctgaccgggccggtgtgcgctggtggaccaaagcatggttcaataaccgggaagagggcgaagcatcggtggagattgagcgagaacaagcgatacgcttcatccacgacaacatcgagaaagatgtatggctggaagagttctatcccaaacagatggaaatttaccacaacgccatcgagcagacaaaagagcaattattaatgaatagaataggataaacatataatacattatggacggaatcaagcatagcggacggtttgcagaaatggaacgccttgtgaacgactatttcaactgccatatcgcacccgtcatgtcaaaaacgcgaactgacctcatacggaatcagggagaggaaatgaaagaatattccacctctttaggtggtattctcagtatgatggcatcttcggcacaacccatgagcgacccctatcagacactcaaggtcacaggcgaatggaactccaaaacgacagaggactatatcgagatgtgcaagacggagattaccggctccaaggaaatgcagcaagaccttgcgtacatggccggacagtggcgggataccgtcgtgcaggaaatcgggagggcacgttacgatgagttgtcagaacagctcggttgtgacctcgcctatgcctatatggaccaccggatagaggaactgatgattgaccgactggtgaaagaacgtatgcccaagtcttccgctgactacatcgtccgaaaggctgccgaatcaagtctgctgggattatcgcagacgttaagccgttcaccgctgaccgatgaaatagaggcacgaggcgaagcagcttatcgcccgaacagatgggaaaaaggtacgggatggatgttgggcacagccgcagataccttgatgatgggtggtgctggttcatggacggcactggcaaaatttgccggtacagatgtggctattgcagccatcgccaatcattttgaaggcaagaagcctgacactctttcagtagaacagtgcatcagtaaaggagtgttcggcagcgacagaaacgtattcgacgattttcgcaaagaggcagcccaaatacaagtcaaagagaacacggcgattggtacagacaacaagcaactgaaaaagaaaatccctgtcatggactttggcttcatggagtggacacaaaaccagaataatggtttattgtggccgaatgtacagaacaaggaacaacagaagcatgaggaacggtacaaggatgtgccgattgttgttgctcccggacaagaagaggcctacttgcagtctttggaacaacgtgacaaagcggaaatggtcaggacagaacaggatgaaactatgaaagaagagaagcatgaaaccgttgttcctgccaatgacgcggaacaacatgtacaaacgatacaaagtgcgcaagtaacacagggaaacggaaacggttggggcggactgcttggtatgctgggactggatggcataggtaatatgacaggtaatctcggttatgtaatggccatgctccctgatgttctgttgggaatattcacaggcaaaacagaatcgttgcgcttgggaaacaacatgttaccgatagcgagcattgtggcgggtatgtttgtgcgtaacccgttgctgaaaatgctcctgattggtctgggaggtatgaacctgttgaataaggtaggacacgaggccttgaaagaacgaacagagggaaaactgaacgtaacaaacgggaacaatgtacagtaccgacactatacgaatgaagctctgaacccacgtatcgtgaaccctgtattgcaaaatagcacgttgattgccacgatagaccgagtaccgtgtaccatccagttgtcaccggttgtagcagaagcctaccgtaccggagcattgcctttgaacacgctggcaaatgctgtccttgccaagagtgaccagcttcgccaggctgctgcacggaattatgaggacggaaaacaggaaaccatcgtgcgtccacggggtattcaataatcatataatcaaataaacgatatgaaagaaaaatcacaaatcgaaaagaaagccgaggaaaaacaaatcaccttgctttctacggctttgagtgaagcctcgaatgccggtggacactggctcaacgcatcgggaaagggatacccacgcttctatccaaggggtgtttctgtcagtgcattcaatgcgctgttcatgacgttgcattccgataaaaatggatgcaaaaccaaccagttcacgctattcagcgatgccaaggcacaaggagcctcggtgcgtgaaaatgagcagggagttccatttttgttttacaattggaacaagtacgttcaccgtaataatccggaacaggttatcagccgtgatgactacatgaaactgtatgaagaggaacaaaaattatataaaggtgtacacaaccgtgaaattcgtactttgttcaacattgaccagacgacactaccttacgtggataaggagcgatacgaaacgacgttgcggcggtatggcagtgcagtggaaagaggatatacggaagctgacaaccgacggttgcatattcaattcaacgacttcctgctgaggatgcgggacaaccttgtgcctgtgcgttcggacggaagcggtgtaccccactacgaaacagataaggatgcggtctatatgccgcgacaaagagagttcggacattatcacgactatatacaggaagccttgcggcaaatcgtgagtgctaccggacaccaacaacggttggcgcgtgaaggtatggtgatgaagaacggtgtggctccctcggaggatgccgtcagacaggagcggttggtcgtggaactggcttcgggaattaaaatgttggaactggggttgccagcacggttgtctgaagaaagtctgaagacagtggaatactggtgccgggagctgaaagagaacccaaacttgatggacgccctcgaaagtgacgtgaacaatgccatcgaagtaatcaataaagcggaacggggcgagaaaatcgaatacgccaccatgcgcaaccggcgggacacttcaaccatgcaggagcagatgcccaaacattattttgtggccaacgagattcggcagcatccggataaagaaacgaaaaaaattgtgcttgttattgacccacaggcaaaaaccgcagacgtgattctcccagcaggggcatcaacagaggtagataacgagataccaggaatgaacaagggacgcatcatgcgagcgttgcagaaagagggaatcgagcaggtacgcttctacaatacggatggtgcattaggttatcggcccgatgacagttattttgccgagaagatgattacgttggcccggctgaagaactgggcgatggagaaactctccacactggacgtggcttcggcagtcaaacaggctaatgagatcggatttgaccacgtagagatgattcaagacgataagaaacgatgggcactttatatcaaacccgaaaataagagcggatatagcatctatcctgataaagaagatataaaccgcttcttttcaacgctcaagcaagcgatggataacatcggtaaggtgcggatggaactggcgcacaagtattatgcgctggccgaggtcaaacctgacctgaaggtggatttgttccacagcgaaatgccggaaattgatttgaaccgtatccagcgtgtttcggttttcaaaaccaaacaagacggcatacagtgtgtcgcaaccatcgacggacagaaacagcctgcccgaagtgtcactccgcaacagtggcagcggatgtggatagcggaagaacgtgacagctacaaacgtcatctggcagctactctttttgcagacgtactgcaaaaaggacaatcgcaggaagcacacaccggagagaaacaacagaaagaagcagagttgtggccgatagaaacggcagcgcaggaacggacggaatcagacaatgagggaatttcaccggagcggcagttgtgggacaaacttaaggcgaaccatcccgatgccttgcaactgcttcgcacgaaagatggttatcggctctataacgaagatgcggtacagggtgcaaagatattgggcatagccctgaaagagtatccggaacgggacattacggcttcaacggaatttccaacggaacagctcgacagctatctgtctaagctcgtccgtgccggggcacgggttgctatcagtgacatggaggaacaagaaacacacagaggttttcatagataaggagtaaggaaatgagcaagaaccaacaatacgcaatgaaatatgcagagtatgctatggagcagatgcgccgatacggaatacccgcatccgtgacgttggcacaaggcatactggaaagttccaacggacaaagccgtttggcgcagaacgaaaacaaccattttggcatcaaggctacgcctgcatggattgccgaaggaggaaggtatggcatatatactgacgataagccgaatgagaagttttgcagttatgacagcgtgggtgattcatacgaacaccactcccgttttctgaaagagaacagccgctatgcccgatgttttgcactttcacccgacgattacaagggttggacacaaaatatcgaacaggctggttatgccacaggcggagaatatgccgagagcctgcaacggattatagagcaaaatggcttacagcagtatgacaaactggtgatgcaggaaatggaaacacagggtaagcggttcggtgcggaacataatcctctccgaacgtctgaaaattcagagtatggtgcggaatactcattcccggtagagcgtgaagagtttctttttgttacctcgcctttcggtatgcggcaagatccgatggacaacacgaaacaacagatgcacaagggaattgatatccgttgcaatggcgatgcggtactggctactgagaacaacgggaaggtggtggctgtgaaccagaacaagaacacgcccggtgggaaatcgctgactgtggaatatacccgaacggatggtagcaaggtacaatgtacttatatgcaccttaaggaggttgctgtaaaggtcggtgatgtagtacaagccggtggaaagctcggcacatcgggcaacacaggtacacgtacaacgggcgaacatctacatttcggcgtgacaaacttctatgcagacggaacaaagcgtgacatcgaccctgcggcttatctgactgaaatcgcacagaaaggtaatatcaaattggaagtgttgcacaacgggaacagcctgctcacccgatataaaggaacagaagagaatgccgccggcaaaaacctttcacccgacggatggatgaagaagctgctttcgtcagaggatagcggtgtgggaatgtctggatgcaatgaccctatagtagagatggcgatgacagcctttagttcccttatgctcttggccgtacaaatcgacaacaagaacgaggaggagcaaaagactgccatatcgaaacaaatggacagcgggcgcatcaatctgaaatcattgttgccgggcatgaaaaactgtgaactggcaatcagtgaaaatggaaaggctattctgcgagtggacaatggagagctgcgtatgtcacgtgagttgactactgcggagctaagccgtctgtcggcaacattgaataacaacactctcacagaagaagccaaaaggatacgtgtaaccggtatgctgaatacggttatcctctcggaagcggcttcacagaattttgaacaagggatgtcccaacagcaggggcagacagagaacttaaaaagatagaggcgtggcgatatggtaaaatgcgtgatgatacagctatgcagatgtctgttcggactgtcctaccttgccttgtatgtcctgctctgctaccaactcttcggctggatggcaacgctccttatcatgagcgttcaactgttccttgccggatggttgatttgggcaatgatacgagcacccgattaaaagcaatgatttagcagttcaacaacaaatcatggcaacaccgttgtcgggtgattatgtatcacattaaaagacaatagaaatgataaaatgtaatgttacggtatgcggcgtcatcggacgtgatgcgtcgatacgcacaaacaaggaagggaaaacgttcctggttttccctcttcaagtgatgattcctgacacagacgggaagactatgcctattgaggtggatgtcagcaaagatactgccggagaggaggtctccaattatcgaaatggttcccgcgttgaggtttcggggacaatgtatctcaaacaccgtggtgacaaactttatttcaatctttttactaacgaaattcgtacagctacggcagatgtgaaggatacggtcaaaggcgaattggtatttcgaggtaaggtcgggcagcatatcgaggaaaaaagggataagaaagaccagccttacacaatgttctcggcattcagtacggagaaagtagaggatggctttgaataccaatgggtacgttttttctgttttggcaaagaacgcgaagcatggttacagccaggcgtgcgagtggatgccaaaggtgaaataaccctttcggcatataacgggaaggtgaatgtttcatgcaaggtggaagaacttgtacagtatgtagcagattcgtctaattccaatcagtaaaggatatggccggatataaaaaacagcacacggacgggccgaacagtgaggataaagcattagacctcttcgctgaaatgatgattgagaaaatcgagagtatccgtaaggattggagaaagccctggttcacggaaggagcgttgcaatggccccgcaatctttccggacgtgagtataacggcatgaatgccattatgttgcttatacactgtgaaaaggaaggttacaagattccgcgcttctgcacttttgagtgtgtacaacggctcaacaaatccgataaggacaatcaggagaaacctcgtgtttctgtacttcgtggagagaaatcattcccaatcatgctgactacattcacctgcatacataaggattctggtgagaagattaagtatgatgactacaaaaaactatctgataacgagaagaaggaatacaatgtttatccgaagatgcaagtattccgagtctttaacgtggcacagaccaacttgcaggaggcaagaccggagttgtggcaaaaactcgaaaaagagtattcgctatcgaagattgagaacggagaacatttcagcttcgcgcccgtcgatgcgctgataaaggacaatctgtggatttgtccgatcaaaccacagcatcaggataacgcttactactctatatcgaaaaatgaaatcgttgtgccggaaaaggagcagttcaaatccggagaggcgttctatggaacactattccatgagatgacacactcaaccggtgcggaaggagtccttgaccgtatcaagccgacaactttcggctcggcagagtacgcgcgcgaagaactggtggccgagttaggcagcgcattggtcgcccaacgttacggcatgacgaaacatataaaagaggacagttgtgcgtacctcaaaggatggctcgacgaattgaaggaatcaccgcaattcatcaaaacaactctgttggatgtgaaaagagcagcttctctgattacccaaaaggtggataagattgcactggaactgaagcataacattgatgaagcacaaacagcagcaccgaaagaaaaagtgtattattcttccgtggcttatcttcagcttaccgatgacacgatgcggttggacgcattcaaggataaaggggactacgaaggattgctgactctcgccaaggagtattatgacggtaacggcattaacgaagaatatacttattcttctcccatacagaaccgaggagacaatcttttgattgaggacaaggattttgctgtggtgtacaatgggagtgtcgggggaacttatgacgtgatgctgaaattcacggaaaaggaagtacgcgaccatatcaggcgttatggtattgaacgtgctggagatacgttaaaaggggtagccaaggagatggctgcggaacaattcgccatcatgacacagcaaaagactcctgcatttgaaatgccgaacggtgacgtgctgtatgtcagttataacaaagaatccgacatgatagatgtcgggccggttactaatgcgggaattgtcgcacaacatcgtttcccatacgatcataatgcttcgttggatgccaacctgcaaactgtgaacgaaaaattgaatgatatggaggaatatcgggaagagctacaagaggcagagtacggtggcagaatgcgccgataaaacagaaaaaagatgcggagcaggtttgctccgtaccttttcttgtttatttgcaatttattacatattactctaacaaattatctatcatagactgtaaatttgttatatcgcaatactgattatgtccccctctgtaatctttcgcatgttgggctgtccgtatcaagaaagaatcaagttctatttttacactgcgacctattcgggacaaaccggaagagtgactgatgtaaacgaatttgccgttgcgctcaatgaaacaagaggtattataatgcccttttaagttggatattacttttgcgccaactgctgctgcgtacttggaaatctcacgtactaaagctgtttgaaaactgcggtattcttttgaaacataggctcctgcatctgcaaggattgcattctgccatttggtataaaaattctgtgccatatttttaaatattaattctgtaaataattctcccaactctctttgtcaatagttaatttgttcatttcccaatcgtattccacttccggcatatcagaataagggaagtacacagtgtagcctatctgtccataagaacaatgtagcggtataacgcaaatctcctgaccacaataaggctgtggcgtacaatatttcttccaatcaaaacgacctgctgctatattacagcaaagtaattttagagttactatacctttccaactctgaaaatcttttttataaccttttttcatactactaatgtgctatattataataaacttcgggttcacttgacacgttgtaaatccagcttccgcaacgtaccaatagagcattcttgccataatagagtttcttcattccggttatacttcctgttatgtgaaagttagggaaacgactgatgtctattttctgtgcatcgcatctgtagagtgttttagttctcattgcatttatttttttaagttgttttttatttccctcttcttgaagccttccgacttcacccaagaggttgtttcatgtgcattttcaacggtggatgcaagaactatgagcaagtaaccggaatgaaattttatgaataccggaatctgtgattgcggaaggttacgtcaaatttcatttcaggtagcaacagcggtacttgaacatcgtttgccaccgtacctttgcgcacgaaacaaacaacggtgcatgtcgggactgtgagaatgtaatacaattagaacaggtaatatagaatcggtaaaagaggctgtgaattggtaacagaggttcggcagaacatggtctataaaagtaaccggactgttatataggaagatgataaccacccgcttgagttgcgggtggctttaaaaaaattatatggagtatcagaagtgatagtcgatgactcctccgatatagagtatcgttcccggttcaagcgtacagacaaactccataaatgcaaaagatttttcggcaaatgactggtatccctctccgtccaaatagaaatgatacgcaatatccaatggattttccaatgccttttcaagttgataaacagggcctacaaactccaacatattttccgttgtaatagcttcagctttcttacggatgttagtcacaaagttctctttccattgttccacaccaccaatgtagcgcatggtgtcatcacctacaagttcgaacatatctttgggtagggcagtattgaccaaataacgaatatcttccttacgttcttcgtcatctatctccgcacaatagtcatagaaactgccatctccctgatggagagtgtcttcattcagatagttttcttttcctatccacattttagaaatctgaaaaattcggctgtgcataattttaaaatttaaatgattaaactttattccctttgcttgaagctcttccggcttcttgtcaggaatgatttttatgcgaaattgacagtaaggaaaggatggataaggcaagtgaatagtgaatggaatgaagtggaatacccaaatcttcgatatgcagaaggctgccacaagtatccggaaactgttagcgcagcgttacttgacgaccattctaaagctgtatctttgcatacaaaatctctcagataagaactgccgatgtgcgatataaagaatatccggattggaagaatataaaagactggagaagcactctgcgactgtataaaagggctgaaagagacaaagtctctccaatctgcatggcaaattagagaggcttatcggataatgatagttcgctgaacgctgtcagcataccgtcatttcgttttctgcatcggattagtcttagcctgcggcatattcatagatgttacagaaagatttgtcattttcatctttccattgttcggcaatagcaagaatttctgttattgattcgacagactgaccgcttatctcctcaaaccacttgaatatttctgtctggttgacaaaatattccttgtaccgtttgccgtctggagtacataggtctgcaatgtactggtcgggaaagtatttgccctcttggtcatttgtccaatactcagccagacttggctcttccgattgatagaaataacatagtgttgggaatttctcacatacaagttcaaatgtttcatcacacggagaccaagctgtttccgttgtgaatttcaagatattaccctccatttcgaggttactccagtcacctcggcaatgaattttgttataatcgccacccaaagcattcacaaggcatcccaaccatgttttaccgaaaccgttaggaacagacggttctttctgttcttgtaaccttttcatcaacttgtagaggctctttacttcttccgcgtcaccctctatagcatatgacgcactgcaccaatttggcataatcgtaattttttatattagaatttcttttattcccttttttgaagccttccgacttcgtccaaaaggagtgttttcatgtgcgtttcaaacggtgaatacaaaaacaacggacaaggaatcagaaatgaaattttatgaataccggaatctgtgattacggaaggttacgtcaaatttcttttcaggtagtgacagcggtacttggacactgtttgtccaccgtacctttgcacacgaaaacaaacctacggcgtatgtcaggccaataaatgtgttatactgttagaaatggagtacgacgagtaaaaaaggaataagagcggtaacgggagttcggtggagcatggctataagagtaatcaggctgaatatacaatacaaggaaatgctatccacctgctttggctacaggtggatatgttgttgtcattccgcacctcttatgatggtgagttggtcgggacggttaggaaaccaataagaatcactgtcaatatatacacatctgccactattacagagattcccaaaagctaagacctcacaaggtccaaatatcactccataatcgtttgtaaacgccaccatatctcccacactcaagtcgttttccgtatccatcactttggaaaggtggtcgtaaaactcaataccttcagcttcacgttctgttttccaacgcaaaaagtcttctttatgacttctaccggtatgtatcggtgataattctgaaggaaaaacctccgcttccgaagtatcagatgcaatcaaaataacgctatcctcttcaatgttttccggaatagaagccacttggtaaaccccattagacagaccactatctgggtcatgccaataaagaagattacccagcttgataaaatcgtattttcccatattctttgatttattatttccctttgcttgaagctctttcggcttcttgccggggattgatttttatgcaggattaacagtggaataagggcgataagacaagtaaacagtgaatggaatggaacggaatacccacccttcgaatgtcagagcagaagcaggcttgtccttttataccttgcaatgagaaggggactgaaagtcaatctttgattcgaggaaggctgccgtaaaatatccaggaaccgttagcatagcggtgcttgacaatcgcccggacactgtacctttgcatataaaatctcttcggccagatttgccgatggtgcgataagggaatactcagaatggaaaaacataaaaaggggtatcatgttataggcgaaatatataacagagctaatataagtcctaaaaaaatatttttgctatctttgccaacgtattatataatattaagaacataacaatggaaaaaacatttacacaaatctgtgaattgttcgatcaattctcaaaagatgccaacctccagatggagaaaggcaacaaagctgccggaactcgtgcccgcaaagtatcacttgaacttgaaaaacttctcaaacagttcagaaaagagtcacttgaagcatcgaaataactttcattctggttctgacagtaggaatatggcgaacttcacgtgtaccatatcgaaaaagcctcttcgcttcacagcggagaggcttcattgattatgacaaagttaaacatcaattatgcgaaatttctatttcgcttttggaaaaaacaactccactttcgtatgtctgttggcttccacgggcatatagtcggcaattccacctttgctaactctgataatccgcttggctggtattccacgttgttccagttctgcggtaataaaacctgctctcgatatactcaaagaatcattgatacttgatgttcctgtagaactgtcggcagcaccagttaccctcacggataaactgtatttcttagctacacgagccagttcgtcaagattaagcctctgtgaggtatccgtcaaatgtgtcgtattgagagcaaagaagaaatagatgggtgcaccgatgcactctccatcagcgtatgaaagaaccgtggaatccatagcgagagtgtcctgatgggcggacagcacatttcgggaagccgtataattatacgatggctttccattctcagtctgaagaatagtcgtgtcaagaggtgacgacccgtcccaatagctatgcttcaaccttgcacgaagcgagttcaaaccgctataattatttataggatatctgcatccggttatatcgtcgttgtcaaagatatggctatatgtatcgagtagtccttcgatttccagaattttctttaattccacgagcgttcgcttgtcttgattgtgacgtcccacataacgcctgttctcctccgaaaggaagttaccataatcgacaagcagttcgttccgatggatgtagggtgccgtatccaccgcgcgcttccagccgaccttaccgagatgaaaggtgaatccggcagtcagcgaaagcatgtgatcgcccggacggtttggatagccatacccgtcgaaatcctggaatgtagttgtgttagagagttccagcatagcactaacccgtttggaaatacggtattgtgtttgtatgccgtaagaaagcgcaaagggattgttcccgttggtggcgttatgtagcagaccgacacccataaagggtgcaagtctccaacgtacctgttcctgtcgggcatatctgcgtccaaggagattccacaggagatctgcatggatataatggtaatcctgcgtagataattgtgcatccttaaactgcaagccactataatttacccttgcgccgaccaaaggagtaaaccacttgccgacagcgaggctgtacgaaggtttcactcgtccaaaaaggtcttcacaaccgagaggtgtaccaagaaaaactgtcgcacctccggatatgctaacaaaccagttgccggttcgggatgccggaagtagcaccccgttgagatagacgggctgcatcggttgaagcaattccgctacttcataatgaatagtgtgtcgtacagtgtccttctgtacgggttgtacacttgcttgtgcctgcaacgtgcagagcaaagcgaagatgaaaataatttgtttcgtcatattccaatgatttcattagttatacttttaatcaggtgtaaggcgtatgccatttaccgtttagatttcttgccgatagtcgagcgcatcatgcggctcgccatcctcatacagcggagtgcccatgctcgattgtcctcgtcctcgtcgcgtccccatttgaggtcacttcctccgcctccaccaccatgtgattcggcaaatgtagtggcatcatctaccattccgagaaatagcattgtcgcacagtgcatgatttccgtaccccgctcggcgatagactgtaccagtgaatcgtcaaagagctgtcgttctgaaacattcatttgtgccgatgcgttacgatactcgctgattatactctccagtaggacgtctttaaacaagctatccactttggagtgtacatcacgggaatattgataggcctcctctttgagttcttcggtacgttcttcaatggcccccatatcctttttcagttcgaagagttgccggtcagccgtctgcaacttttcctgcttgtctgccagttgtctgatgattccttgcagctctttttccaacatttgtatttggattgccaattctgccgcattgcctttgttttcttttaaattgtactcggctgccgataacaaggtttctttttcagttttctgcttttcaagattgctaaccattgtcgtaagccctttgactctgcgttctgccaaccggatgtctgattgaagttcacccaatacctgttgatggcgtttgatattatcctcgattgttgtacactcttcagacaacattcggcggtattcctcagtcgttctgtgccgtgcacccgtttcggatatgcttgttcctcttgacattccccactttgtattgacttctgcgaaaaagtccgtatgaagttgtttcattcttgcactatattcaaacttatccttaccggcgaagatttccttgtacgcaaagcgactatccttgattggcagaagcgtacagtggatatgcgggttcaattcatccagatgtacaatgaatgcagcgatgttctgctcaccatatctgccacaaacgaatgaataaacatccttcgcccagcgttcaatgtcacgcttccgttcgatgcgggtattgtccgctcctttttcaaagtccacctgttgcgtaccgaaagcaagttcctgcattcgcttccgtgaaccgccgaagataatatttaccaccgtgcggtattttggttcgagcagcccctcattaggatctttgattccacggtgacttaatatgtccgccatccgttcgggaatgctacggcttgtgtcgatgggatgtattttacctccgggcgcaatctcgaagttcagccgtttacgcgtaggatcataatttcccttactcatagcgtacttctctgccttttcactacggtcacgcagatgttcattactttgggcggtggtaatccctttcgacacctgcacgtcgagtacctgtttttgattagccatacgtttttcatattgttgcggacaatctaccgtgtcccagcttgctgcttgttcggacacccttcccaccgacgtcaggcaggtggggtattaggctcccccttccctttgttcgtggcagacgggcaagcccggatgccttctataactggcaggggtcttcactggatacaaaagtagattgttgcggttatacgttctgttttcaatctccaatctggtacgttgcctcttgtgcctttgcagcgaatgccagaaaaggcttaaaaagcgttttaaggaactccctgtcatcttcatcataatcggtattgtcatccctatctacatcaagaataagcccggcaatacctttcgaagttgcgacaagtcctgtccagtccccatacaattccaatcggaagtagtccataaactctgcactgtcgtcgaatctcgacttacgcagtgcccgttgtatggcggcaaatgcaatgcactccaaagctaccatacgaatcttgacagcccgttcatcatcatccgctgccagattgatgcgagtgatactgtccggagatgggcagttatcgcatatgccagcttcatccattgcccgacgaacaagttgttcacacttgataccggtttcgtcaagggacactttgccgattatccaatcggacaatacctcacgtagctgttctgcaaggttcaacttcttctgtccattgcaagactccgtggattggctggtttgcacagtcatggtaatgatgacgcttttggaaagccggatgcgattcaacaagccgaactcttccattacatccaaaaaagaacggacagtagccctatgccaatgccattccgatgaaaggtcggaaacagtcacgtggcactggttgggttgaagttcgtagcctttgttccttaaaaaaggggaaacaaaacctgccaaagatttatccaacaaatcacagaaggcttctgtctttgtttttcgttcaccgactttctccttgaggtagtcaaaaacttctctgtctgccaatatagggacagctattttctgcttggttttcattttcatttcatttttaaattattactattgtgcggatatatcagtgttgccgctatccgcatcttgcggcaatatcgcgtgatgatggtcataataactttcggctaatagtccggggaatttcatccattcagagattatgcctatgtcctgaaattcggtcatgacccgaacagagggatagaacagggcagccaaaagaagataggcggcagttaccgccgtcgtgtacaagtgtggaacaagactgatggccaatgccaccaatgagagtatggcaaacatacatggtcggtcacataaacctcttaataacttgtccgctctcctaaatgaatatatagcggcacagacagcggttgaaagaaaaatacctaactcgccaacatgtccgctgatgtaaacatagtggaagagcaatagcagaatcaatacgacccgtacatatagtttacgagcctttacactgtgtatcatagcatcatagaaccttaccataaaagaacggtggctcttgtacaatgctaatggcaatacgaaaagtattatacagaagataagttgtagtatattccaaatcataaataatagggtttttcgcgtatttgaatgggtggtatcaccaactctaattggacaatattgtgggtggccaacaagatgataacttcggcatccctcggtgaaaggtatatcgctgctttcttaatacgttgcttgaacgtatgctcctgcttgcggtaggctgccaatgccttatccagtttatgttctggaattgtccatgtcatgcctttggcgtatgagcctttgtctttgtaagcccgcagtatcaacgtgcgggaaacaatgtagttgatatatccgtttcttgacaaagcatactccttgtagaaattgtcatcaacaacctctatccacgtccggtattccctaatccaataaaccatttgtcggtatagtgtatcccgcataacatggccattaaaggaaattcatcaagagatcgtctttgttcttcttatacttgaatgtaccacttttggaatgaagttccaaatcaaggcacagctcgccgtacatctgctcaagagaatcatagatggtaacaagaatgctatttaccttaccgtctgcatctgtcttgcaattcatcttgaacatctgtccaaatgctgggttggagtatgcacaggtgctatgcccgaatttgtcagcgtgcgtggggatgtggtggtagagagttataagctccatatcgtcctcaaacagatccatcacttcctccaagtcgtaagggtcgcgtagcgggaaggtcagtagggcgtagtcaccgtagaattgtgcttcctccattgtcgtcacatcaagcagttgcggtagttgcagagggacaaatgtcataaagtcattgaaaaaatgtcgtaacatattcatatttttatattgttagagcgtctgtatgaaaatatccataagcattcctggcaattcagtcagttgaccactttccgattgcaggattcggctcaaggttttgaacgtcacaggtgtctgtgccgccatccggtcaagttgtttccgttctttatcggaaagcaatgtcatagagaatccgtccagtgaagtataaggttggataagcatccatatataggcatgtgcttgcgaagaggtcttgatttttttgttccgaacatcttctatacaaatctgcatattttgtatttggcgacggttggtgcgcatcgtcaaataaagcatagcctcccgataggtaatctcttttctctcggcggcaaggaatatctgcgaacaacactgttcggtaccacgtgtgatgtcaaccatactctcaccctcgaaatcgtgcaagtgagagaggaacgcacggaatatggcatcttctttagtgatataagtaatcagttcattgcggctatgtatgccattacggatagttcgggtcagtaacatacggtatgccgcaaggatttgctctttgttacccttatgaaacggaaggttatccagtgagttgaaaaatgggcggatttctccagcggcatgatgcagttcctcatcattgttataaggtgagaactctcctttgagagccaaaagttcctgataagtacgcgtctttgagagggctaagcgtgagaactcaatgcggatagaatcatgcagtctgatacactcttcacgctgattggaatgggggtgactgatcgtatcattccggaaatgcctaaaaacagagtcttttacagtttgccattgtaggatatgttcggtcaatacttgaaatgaagaatctttctgacgtcgtatattgtacaaatactccctgtatattccggcaggatcgttcgtagcttcagacaatgatttgccatttctatcgctgcatgatatcaggcccaatatggtcaatgaaacgatacatcttccagtcaaaaatgatggagtcttgtagtatgattttaaaattttcatattcaacaattcatatttaacaatgcaaatctatatattatttttgttgcaaaagcccttttatatcgcatttagtataatttttggtatcatattaacaatatgattgtcaatgaaaataagtgcaagaaaaagagctaaaaaaaggattcagcgagattttttccacgatatgattttagattcaaatgaaagtgctatatttgcacttgttatcaaaacagtgtatattaaaatggcaaaagttggctatatattcaaggaaaataatgacagttttgatgctgagagagaatggatgcagcgatacggttgtgtacaaatcgtagaggaaacagttgaacatgaaacattgagacctatgtggaaacagcttatggcgaatcttcaaaggggcgatgaaatagtcatatccaaattcagcaatgccgcacgcggcttaagagaactggccgcgttcatcgaactatgccgtatcaaaattgtacgtgtcatatccattcatgacagagttgatactcgcggtgaattattccccggtacgacagcagccgatgtgttgtggataataggggcatttccggaagaaattgccgcactacgaaaatattccgctcatgtcgagaagttacgccagaatatcaaagccccggctgtgccgaaggtattacctaaagcagaacgagataagacaatcgtggatatgtatatcaacggtcattctttcgatgatatttgggctgcaagcggttttagcagcaaaagttctatttggcgcatactcaataaatatggcgtaaaacttgatcgtggccaaaccagcggtccgcgtgtcaaacagaaaccggaagaggacggaacaaatgaaggtgattcctgatagaattttcacataatcaagatcgtatatttgtttttcggttattattttgtatttttattattgttaaaactataaaagtaagacttatgggagatattataattgtattgctggtattctgggttgtcggcaagctcctgaagggcgtgtttggcggtttcagtaaaagcagtttcaaagatgataagtaggccagccaagggatgggtaaatacggtcaaaaagactggttcaagaggcgtgaaattgtaaaaagggagtggaatggaataaatataaacggagcttccggcaacaggaatccaggatatatcggttgagatataccctgaatacatgtcggatattgtctgtccggagatgtttaggctttccacctatatccctcgtctgtcagttccaagtattcctctaatcccggttttacgaaaaagacaatttcaaaggcttcgttacttccgttatcggggaatgtcatgtcggtttctccatttcggataatccctttacccacgttggaaccaaggtcttcatccgcataggcatacagaaactcgatgtccggaaatttctcggagagtgtttggataagtagcggcacacctgcccaagccgtatcaaaccaaagcacgttcggttcttcaaaattctgattaagggcattccattttgtaccccagttggcgatagaccactcgtaccaagtggtataaccgtactttctttgattttccagatacaatactccaagctgtaacgcttcttttctgccttcttccgtcaatccttccatccattgaatgactttcaaatcgtccggagaattgaatggcttgcgttgcattgctttgagatatttcataccaaattccccagaagtggacgcctctatcagtaggtcctttggcatagggataatgttgttgaaatcaatatagcaaggcatactgtcttcatcagtttctccttttaagaaatccatcacattttgtactgtttctctgtctgcgtttatttctaaacggtttgttacataattgggcatgattttaattgtttaaaaattggttagtattaacttttattttccctattgtcggttctttactgattgaaccgttttgggatttatggatgcggcaaacggctgttgatacagcttcatacggcaacttttcttgccaaattactcttgcgcaggaaggaagaattttgcaagaaatacatttcaagtagccgaatcaagcgcgacagccgacctttgcatctgataaaaccaaaccggtgataggatgaagaatagatgggagataaaatgaaaaataattaatataaaagaggaatgctattctttttgcagaaatataaaaaaggaatagaatgatataattataaaagaaggactattattgccctctcaattataagagggtatgttctcaaactccgacccttgtttgtaataatgtaataccgtaacacctccgttaaaggtcgttacggtatttttttgaattattcttgtgttacttccatagccttactgtattctttgatttgctcctttgtcagccattcgggtttttcgttttcccggaatctgtcgtgaattttcgtcatatactcaatttgtgtcttttcagaaccagcccacaaacgatgaggacttttgtttccaaagccaagataatattcacagtcggcttgcaaacgacccaataacatatacctgaattttaaatcatgctgtaatacttcttctattgtcatactcgttttcgttttaattaagttttttattttcccttttttcaagtctttcgactttgcctgaagggttgtttttcatgtgcgtcccaaacgacgaagcaggaacgcagtgcaaggaatcgggaatgaaattttatgaataccgaaatctatgatttaggaagattacgtcaaatttcatttcggatagcgtagcgatacttgaatagcgttcgttcgccgtaattttgcacacgaaaacaagaccgggcgaaagtctggataacgacaggaaacatcaacattcattacataaggactgtaaaagagagcaggcagttacgctgctataaaagggaaacaaggaaattaaaaaagtgggcacggggcaatctgtaaaaaagggggatgccacctgtcttcggacaaaagaagataccataccgataggatttaaccgatacggtatctctttggtagtcatcagtaccatactttcagaaaaccatttaaaaacattcgatattcgcctcttggaaaatctgcggggcgtgctgataaagcaaaggaagattcaataccgccattggatattctacaaatccgcttctacgcttgtaaccggaataagtcgctaaattatttgtctccagaaactccattgcatccggataatggttcacatcaataaatgtacggtctggcaaatcgagtgcatccatgctctccaaattgacggatagcacgatatactctgcttcatcttccacactttgcaaagtaagtgctaaccagccattgccataaaattgaggcatgagataaaagcgttctccacgaaactcgtattctttccgcgttagggagctgtccggctctaccaagcgaaattcatcctctccggaaacaaattctgttgatgggtcgctgacatccacatacgttccatttacattgtgacacaaatactctgcattttctgaacgaacaatcacaaattgaatttccatactttcaaaatttagctattaaacatcatgttctttttttcccttttttcggaagcctttaggcttctccagtcgggatttgatttttacgtgcattcaagattgcctttaaggaaaagcaggcaaggaatttggacagattttttacagttgcggtatggagcatatgcgacatttgagcgattgaaaatcgggaaagctactgaaaaattgtgttcaaatagcgtagcggtacttgaatgtttttccgtggcaatacttttgcacaggaaaaaacaagtcctgactggtagcagcctgaaacgaaataatttcgttttatacaagggtaaaacggagtgataaaaaagggaatgaccacacaaagaacagccgacaaaagccggctttcttttgttcctgtgggaggagctgaagcattcaatccgttacatcataataatagcttagctcgtcatctttcagatactccattgcatattgactggcttgtgcccaaagggtattatacaatgtcgcaatttccggccttgtttcataatactgccatatcttatggttaagcactaaaaccagttccgtgagatacttgtagttctctttccactccttaaaagcacggttgaaagtgtcctgtaccgccgaaagaccaaatcggtcagcaatggaaaaatcattccaaaaggttgtttgcaattcataaccgttctctaacataaattctctgaatgtcataatgcctcaaattttaaagattaatattttatttatttcccttcgatacttcctgtaccgaaaggttgattatttttctgcccacgggattggcggccagaacaggcaaggaggatgcggaaaatacactcttcgatatttcggagaggaagattttacagcagcaagtgtcagcgatccttgacaggacggacagccggcaatcgaattttgcagggaaataaccaggcttgcgggatagaaatatagggggtagctgggatggggctataaaggagggccggagtctaaaaaaggaaactggcacaagcggccacctacaacagttgggcggggacattcataaatgtgtaaaaaggactggtttcccaccacatttttgcagaaatatacggcataaaacacaagtgccgtaacagcctcttgagaaagcgttacggcatttgtttaagtacaggttacaggctttttacctgaacgaggttgtcctgtagagttttccagccatacactgctgccacataggggtggagggaacgtgtaacttggcgaaaaccattctcgtcaatttcatagttgtagatttttgcggcaatctgttctgcgtcgtcacgattttcagcgacacggtacaaaacataattcgtgccatcatggtgcgacatacggcctcgtatatcgtagccgtcaccgtaccactctgcatcatactgtgtagattgtaatatcccggcaatgttgtcacccaaaatttgatagccttgtttgcgtccgttccacaatcctaaatctccaaatgcaataatgactccattgacatccttgtttaggttctgccactcatcccccaattcattatacacttcgtccgaccactcttcatcgctgactttgtaagcatcatcgtccagttcttctcgcttgaaattttgataatactctcttgctgtttcatccaatagagcatcacttgaccaaattatttgtttcatacattctaattttttattttcccttcccttcagaggcttttacctcgtccggtgggatttgattttacgtgcaaaccacaaggcggaagaagggaacaatgcaaggaggaagcggaatccgaaggatttcatttgaacggcattgactgcaaatgaaacgcgccttgcaggttcacgtccgacttaacttcgcactgtaaaattaatggacggcggacgtaacctcacttttgggaagaatatatggttataagagggactggaaagctgctcagaggtatggaattgagagagtcttcttttttctattgaaaatcgtaatctgcctgttcatcaagcggatctaagtataacagtattaccgggtgaagatttcatttggagcttggcatcgcaacagccacttataaaagtatgatgcgtattaatctggtcatgagcaaaacaaaagcgaccagaaggtcgctttgttcatgataaggcaagaattatttcttgccttttttcacgggctttaccggcttttcaggaacatcctccttttcgataggaggataaaacttgacagccaccataacaacacgattgtgcttcacaccgaccttgtcggtccactcttcaggtctaaagtagccttcaatggtgagcatcgtacctttggtcagttggtcgaatgacccagtattctcgtttttacgccaagtctcaatattcataaaggctgaaatgcggttggtttcctcggcattcctttcctgacggcttacggccaatgggaaacgtgcgacactgctgttggtgaactctcggatttcagcgtctttacctaagaatccggttactgtgaaattgttttcaatctttttcatgttgaattgcttttagaagttattaaatcaatttttacactgcctaaaaagtagatgtcgtttaagggatgcgccaaggatagcgcgtcaatacgctttatttttagccacaggcaaaatcgaaggctcgataaaggaagattgaggcggctacgccattggtcaagacaaccatgtcgttcccgtcggcatactatctttgcagaggaaaaatgatgattgcttcgataaaaagcgattatggaaaatgggaaacaagtaaaccggtaatgataaggaaaaagagcaaagccaaatgtcggcacaaaggcgagacatgcctggcttgaattgagactgtaacaaacagaataccgtccaatcagaaaaaaggtcactgcataaggaatgtgtcagccaagagtggacagaagcgtaggcagcccatccttggaggatagtgatatctgcatcgaaaaaaaatggaactggaaggaaaaacggcagggagaaccagacttttcacaaagtggtttccaattcgctttgcgtgaatggctggtttctacaaaaggaagtggcgcagccaaaagaaaaagttataaaaggaaaatggaagtaaggctgaaatgggtgattccattccagccagtcgatgatatttgtccaaggtgtcattgaaattcaaccatcataatacgatactcgaatattttggttttgtcgctggggcgtcgctggcaaacccaaaggtgtcgtgcaccgtaaccgtatgtgaaatactcatcaagtggagtttttttctccaactgtctcatgctttcacgcaattccgcctcattgccagaaaaaagaatcgtgttaatgattcggaaataaagttcagttacctcgtcacaataggggcaaaagctgtgttcaattgttactttcatgcttcttttgatttttattgtacttcgattatatcttcaattcgaccatataggacagaacgtagtgcggttttgtcaatggcataatattcggcaatatgtccgtgttgtttcacgaaataccgtttgagaacatcggagaagtcaaaacggtagcccattaaagcgatacctcttttgaaatggcagcactctttcacattgcgggtgagccagtttttttcttcccgactcaacttgtcgccattatcaagacgttcccgtaatttgtaaaccttgctatctttcagtttttccaattcgggcacatcccattggacgaatttcattgctatctgtgtcatggttctatgttgtaaaattgtaaaaattacttcgtcacagtatttaataatctctctttgctgtaggatagaccataattttactttatcttcttctactcattcagttactaatttgaccttccattctccctgagagaatattctaaagctcacgtactcgtcttcaaattcataggttagaatcttgatatagactttatctttgtcctccaacgattctaccaattttttgatttcttcttctggatacacccaacgagaggaaaattctgcatctacactatcaccatatcgattggtaaattcgctgaaagtgtcatccaagaaatcctctattttgtcgaggtctgttttattttccgttcttgcgtggaaaatgttggttgcataatttgccataaatactaagttttaagtttgttactttccctcctgtagcatttcacttactttcggacttgattgaaattatgtcgcttcaacaggtggcatggctatgtatgcagggtttcactacaaaatactacctctgcgaagcggagcgtggagattttatagtgaaccttcaggttacaaccttgcatacaataaagacatggcaaatacctttgcgacacaattcccatcaggcagaccgaaagttgatatgcgagcatgtgggagtttactcggtacggatgtgtgtaaaaggtgtctatgaagtaaagagtatcgcagcgaaaagagaaaagaggcaagagcttatcttctcttttggctgtatgggtagaatgggaaaatcacaaaagtaacatgaaaatccagtttggtttagtttgttagccttatatatgctaaactaaattaaactaaatataggcaggcatttttggctgcctgtacaaaaaagattatctttgctacaagcaatacaacttcaagagataataatttgtattctctttatgagctgcaaataatttgttagttaaagttaggagcaaattcttcgaatgatgagagcagataaaattgctcggaatgcactctgaaagcaaacaaacgaaaagaaagaaacagagtgcaaatagaaaaacgagaaatcactttaattcctgtttttgttccttgtttgtttctctattaaaatcattcactttataacatattgattataaaatatttaagtgtgtatttttaaaagagttaagaatatttccaagtaagttgccgcgatccatagctccggatacagtgaaactccatcctttcagttgttgtgggtgacacgccggcgtcggagttcgccttgacgccttccgagatacccttgacctgtgcgcctacgccggtctttaggttggcacttacgctgtcgaaataacctgtgtccgccataactgtcagtctttatcgttatttaactcgaaaatacaaataggcagatgcaacaatggcaatcacaatgattacaccgagccaaaatcggaatccggttggacccaataagtcaagaaagaagtttcctccccagcttccgggtctggcgtatgtccatttccagtcgaatatcagtccgacaagccaaaccaatagcagaaagattactactaagtaccccactttggggttcgcataggcatattcggttgcatcagtgaacagcccttcaagatttcgcaatatgttgttcagccattccattgtattttcctaaatttcttttatactcatacaaataattctcccagtcatctcctaacactttggtcagaacttcatttatttcatcgtcactgaccagcttagagcgtgccgaactgtttaacaggcttaatagcaggagaggataagaggagttctttatcaggtctatggaaagtttgtctgaaagtctgaaaccttccacataacattccgcagctaacgatttctcataattattttcccggcaccaaccacacagtctcaacgcttcactttgcattaggtaatcgttgcatctggagtatgcttcagcaccgcgatagtacgtctctgccgcttctttccaaagtgactctcgtacatagatggaggcctttcccaataaggtgtttccgagcaatcggcaggccaaagaggggtctaatttttcttccccgatttcagcggcttctacggctttgtcggcaaagtacatggctgtcttatagtccttatgggaaatctggtcggtatatagaattgtatatacggttacaaattggctaatccagttaatgtttttcttcacattttcgagggcaatgtcgaggcatttcttcgcaaattcctctgtttgcgttgcgttcccttttttcacactgttcatcagtttgattaatgccagcctgaaatttgaggctgccgggtcgttcttatcctcatttgccgcttgttccgcaagttgctccattgctccgtccaaatctattggcggataaatagacaccgcgtcattggaatgtttggccattagtttgccaaactgttcatggtcttttatgtcggatataccccataccatttgcttgtggaatggcagggcaagagccttttcaaaccattcacgacatccgtcatagtcgtatgtgttctttaggttaaagacaaaactgcatttcatatcagtcccttttacaagggattctgtcagcttgttgaagttggcaactgcgacggaggcatcgttttccgctacttccggtttataatcagctatccaatcaacacgttcaaaaacaatttcttcgggtttctttgaattgttccaatattctacctgttgtgcaatataccctacaacatcttttgagaaatcggttctggaactgaacggaagttctatgacgaacaccatatcttcctcttcgctatcaagggcaagcatatagtcatagaaagcatcaagcatactttcgtctcccggattgatgacgatacgaatcaacttaaccggtttcctgactgcatcttcccattggtagagcatcttatctgctatttgttgtatggcattgctcatatgctgttaattcaatttgacaattgttccggctacggctgtggttccggaagaatctatcgtagcctttgttgtaccgctgactgtagcactgctactgccggatgctgtaaaatctgtactggagatattataattactgcttgctgtacaatcaatattttctgctgactgcgcaatattggcaccggcggactctgttatgtccttttccgcattagatgatatattgccttcgctatcaatcattattttgttttctccaacacacaaggtgatgcttttagaggcagatattgtgatatttccttctccgtctgccgtatagctgttgccttccttgtctttcatcataacgcttcctttttcatcatcaagcgttatggtacaaccgctgcgggtagtcagactttttgttttgtttgaactgccgccaccggtacctgactttccatggaataagctgccaagcacaaacggacggttcgggtcgtcatatctgaatgccaccatgacttggtctcccttttcgggtatgaatacaaatcctctgtttgtggccaccttgtcgcttgtgcctgcgtcaggagtgagtacccgtatccacgaggtttgcatcggaccggtctgccagttcatcttgacttggacacgacctaactttttcgggtcctcgttgctgacaactacggcctgctgtgtatgcgcgacaggcagaggcacatctgggcatggaagggtgggaatagaggacggaagtgcggtgaaatagttctggtaactgtcacccatgccggctacgtgggttatttccgtaatgatataggtgccgatactgttcttgacgaatattttgattccggaatgaatagcggtgtggatatctatgatactgcccaccgtgagggtatagcagtcgctctctccggtgacaaaacaggatgcggcggtgtcgccttgctgcttgcgctggaagtaggcatcaagctcacccttgttggtgatgcgtggttccgaacgttgtacggcgggagcggtaaacagtgccaatgacgagtcaaaggccgcttgtcccaatgtgttctgtccggctgcggcatcaggggactggccgttataggtctggtcgttcaccgaatggtaagaacttccctttattggtcgggcaagtgcctgcgagcagacgtcgagcacggatagttcctcgccgtatatcagcttggtcgttgagccgggctgtggcttcccgaaaacaaggttctgtccgtcgtaatagagccattcctgatattggcgggcaagccgttgtatgaatccgaagttggtttcctcgtactggcattcgtattccaacttcgatttcgtttccggattgacaagagcttgcactcctgccttatctgtaagttccttaacgatgtcagacaaggacttgttgcaccatgaggcacaagtgtggtccgactccagtaggaatgttgacgaatatcccgtcacttttatatttccgtgtgtcccaccagcacgatgaagtcctaccatggtggcgatgccgatgaaaatagtgccgccgaagtccatgattacttttttcccaatccagtcctttgacacattcggtatttccacaccataaatttctacggcctggatatccagcgttatctcaaaatagtggtgctcattaatgctctgtttaagcatcagttttacaaacgacggcatggggatgccggctatttccaatgtgacttttttttgttccagcatggcggcattatatttgacggtttatatccaaattgccaaagccgcccggcggaagtccgtcggacggcctgacaaatgttttgattttaggatttacctatgtacgccgatttatttcttcggccaacggttgtcaagagctgcgctgccgacagtgatttcttcagcggagaacgtgatggtgattgtcataggcacatcgttattcgcgtccagagtttccgagtagtgaacgatgtatgcgttcttgaactggatttccttcatcttggcgtcctcctccgttttcttatagataatcttaccttctacgggtttgaaagcactgttcagcattgactcgataacagaagtgtcttctgttgattcgatagttacttttactctaccgcccaatacgcttgaagagggcatacctttagagtccgtgttacgactgaactcatagtttgaataaaggacgtcaaattccttgttgttaagttctaatgatgctctaaatgccataattcgttggatttaatgagttaaacttaatttttactgcggtctctccgtccttgcgccctaaccggtatagatgcaaaaaagagaaaacctcaaaaacgattttttgaaatttcctctcagcctccggatgactcagttttattgtgggaaaaagagaagaaaataaaacatcatctttgatgtgagcaaatataagtgcttatcttcatttctccaaattttttagcgcgtttttttggctgttgttttcattttaacacgttttaaactaatattcgtgtataaagccactgtcctatatgattaggaatgtaccccgttgatgatgtgtctctattgaattgattcccagtattgtaatggcactttcagaagacgtttcatcagggatggacgtacccgtcggaacgaaaactactgccggaatgcggaaaaaacggtatccaccgcatgaaagtggcagataccgttggcagattgactatgtagtctgaatctttgcgtatatcctaattcttgcgcccatatcggcagatgagcaatgaacttaataccaggagtgcaagggcaatcatccatgtgtagattttccgttccttttccaaatgttcgatgtccgccgcttgttgtttggagcaagttgtcagtatattaatctgggattgttgtgccttgcagatatccataagttcagcattaatccgttgctgtgtttccagcgaagtttggatgttcttgaagttacggttggtcgtatatgcgtcgcggatatatccgggtgtgcttacctgtaacgacggaacctgtatgctgtccggaaggtatgtcagttctgcattattgcgccgctctgttgcgaagctgttgaacaggagtatgccgacgagtgtgccgctaatcagaaaggctattaacgctatgatggcaaatattgtgtttgacggtttcgcaacaggtggttggtactctcgttcaagccatggatgatggttcatcgtgtgaggcggtatggatgtttcatactccacagtccggacttcggcattttcttcggtctcttttttctcaagggccttgcgtcttgatatatccataaattcgcgcttggcaatctggtatttatctgcttgataaatgacaaggtcgttttttaccagccagtcaagaacgtccttgacactccgttctgataccttgaggttgctgatgctccaaaatatctctgcacaagatacccatattggtttctggaggcacttctgatacaagatttcaagtatctctgcctgtagttgttctcttgttggttccatttatttacagtattaattgtttcggaataaaataatatttcttgccggctatgaatacgggcctgaaaaggttgcgttgatacatatcttccagtcttttcatctttgaaatcagggctgtatagccactgttaaagtccgtcagctcaacctttcttttcttcagtttcttcacctttgttgaatttaaaaggctgtcattggccatgactcccgtcttataatagaagatttgagccagatatggatttctgggcaatacttttcgatagaaacttctgtttatgcttttcttttgccgcttgaattgcttgcgaagcactcttaactcctttttccctatgttatctgaaaactccgggagcagtcccctgtagctttgcagcagtcccatcacttccctgtcatcgagtagatacccatattcgtacccgttcattatactgtccgctacggaggcctttatatagtaggtgtcattcacgctatttctatctatatcgtcaaggctcgtactgtcaggattttccgtatgatagaatatatgcgtcaattcggatgtgggacggcttcttaagacacctatatttcgctcataatctttaagcgagtacaacagtaggctgtccgtctcgaaagattgctgaaacacggaatccaaggctgtttccaaagcgttgctttccagcctgtttcgacctttagggaacaagattcctcctaccgtaaggctgttgtatggggcatcatacaggtataagttggcatccgtagcttctatgttcttgaacagttccgtctttaccagtctgttgtctgcgatataattggatatatggtctatgtatttcgtagaatggctgtccagaatggatttggcctgcaataggaagtcctgatacgcagtacctgacgctctgtctatctgggcaaacagaagccttgccggttgggttgccagccacgagagttgttgttcgtgcaaggataaagtttgctttgaccctaaaatgatgaatacattgttgctgaaacggctttcgttatcatagcaggagatttgtttgatagccccgccaaaaccgtaaaacgatgattgttcctcttgctcgttctttcgcttggaagaaatggattgtttgatatagtcgagccaggctgaaaagtccttggtgggggccaaatgtctgttttctccgttgaaggatatgcaagttgccgaaaatgtgtagtcatatccgggcttcattttcagctttaggttctgtagtacattgatatatggggatagataaggtaggtcggcatcattgaacagtacatgtatgttcacgtttttgttttccgcttccatctttcggacatcggaaaccatgatgtctccacctttgatattgataatcttattccagttcttgtcccagacggatagaggatagttcagccggatattcccgtccgttataggccctgccggatttccatccaagttgaacaatatcgtaccctgaatattcgcattatgtagtgccaacgtatcgggatacatcaggttgacggcacataacaaagaatcacggtatcgtgaataatcaacatgatacacttcattctggccgacttctgcaagaaggtcagcgggaatccatcctaagaagcgtttggtactgtctgacaatgcgggtgcattggaaatcaatgcggatttgccgctcttgtccagcttatataggtaaacaacctctccgctgacaactaccgcatccgttgttgttttcagaaacggctctccgtatattttcagggtatctccattgaagaattgatggatatcgaacagcttgttaatgctgtttatgcctatacggtaccttattggctggttgttgcggggattgatataggcatggtcgtacatcagtatattttccgatggtatccatccggcataattgactttacggggttctttaaagtgcctcttgctgttatacaggaaacctataatcgacttgggcttgcctgtaatgtcagggtcggcctgaacgagtttgtaggttccgttcttttcacctactatgtaatagggtgtaccaatcccgtgtgaagaccgcttacgctggaaatacgggtcttcataactttgatttccggtcctgtccgaatagacaattctgtttgtcttgcttttctttgttttgacaggtgcttccgtggattccggataattgaatatatccctatccattatttgtatcctgtcgcggatggacacttgggcagatacgttgcacgcaagagtcatcatcacggccacagaaaacagatttcgtatgagattcagttgtttcatttttcaatataactttgtgtcacatggatggacttgacgcaattcaaatcgtcaatcttcacatcatcaatactcacacgctttttcctgttgctctcaagaaaatgcagtccttggcaatagccgttgaagtcattgtatttttcatcattgatgatgaccactacctggtctgcatcaatgcaaaaatattttttacggatataatttgtatgttcgtaatagaccgacttttgtgagactttggcgtcagctatggcttgcaggtgtttttttatatcattctgtaccagtgccaacgaatctaccgtgaccagttcctctgctttttcaaagcgtgggagaatggttatacggtgctttaccggatatttcgtcgtattggtttgtaatgagatggtgtattctcccggaatatcatacgaatatacgacttgctgctcgtatgcgtccacagtaccgctttcgccaaattcccatagccatgtgtccatgccatagccttctgccgaaaagaccagctcttcgccttgataaccctctgacactccatttatacggggtatggaatcaatggcctcatgctccagtcctgagataaccttgatatacttgtttacggagtgttttccgtctattttcaaagtaataagatatttgccggccttacgataagtgtatgacacatccgtatttctcatcagtgtatcgccgtttcccatttcccaaatgagctgcttgcctttaatcgccgccgtatcgttgactaacagctccaaccgctcattgacctcataatgaaaattatcattggtgtcatacacataaaagtcaatattggcaaggtgcgacttcgaaggcaggaacaagaacaaaaggatacctgccatggcaaccagtcccaatatgatgattgttatagttttcttattatccatcgcgaatgttttataaattggctttacattcttccaaatcccgctcaatcagtgcattgttgtgtaccagactgttcaattcctctttgatgtcgaattggcatttaagcactctggaggacaacacgccgaaaaggaatttcgtattcatattattttccttgtatatatgctgcaattggtaaatcccatccttcacttcgtccatcttttgtacctgatggatgttgaagtccaaagagtcgatttcattccagatgttctgcgcttgctgcatatgtgtatgctggatttcaaaaatgcgctcggaatggttgatgtcgtttatcagttccgaactgtcctctgtcggtacgttgagtatataccggcaaagtatgatataaattgcggctactgagaaaatcagcagcaggagaaaacggatgtttccccatagcacttcgtcttttgtcatggcttcgtcagtttattcttggttaattcctgatatttgattctacacttttcaagttgctccatgttgctttcacgctgtttgctttcgcggtcaaggtcatccatggatgactggatgacacgaatctgttcaagcatggctttatacacttcgtacttgcttttatcggcctgcatcgcaatgtcattttccatcaataaccgttttttggttatcagtttttgcatatgcttgtgttcactcgaatttcgccgcttggtcttcagattgttcaggtcccggaacaattcttctatctggaagttaagttctgcctgtttcttgaacacattgtcatattcggccttcttgctttcaagaagggatattcccttttgtgcagtcacaatcgttacgacacctccggttgtggtaacaatcagtgcgatagcgaataccaaagtaaatcggagtttcgctttcaaacgagcttttttgttttctgcttccatatttgctatgatttaatcgctcaacctataaacgaccatgaccgtttcttttgagcttctattgtttcgtgactttcgtctcctactataatattctcacgaaccattccgatgtattccagttcactcattttgtggaacatattgctgagcagtgtcacaagtgcccctgccgtctgcaatgattggtttatattggtatggtcatacataagtttggttacgctctctatcttcgtgataaattcagagggcgtgacattggtccactcatagaagtattggagcaattgttctctttccgtttcggaaagactttgaagagcggagttcagaccgtttgcaagttcgttcacggcctgcacaagatatatcggcggttgctctaaggcaatttgctcgataaagaagattcttgagttgtaaaaggcagagaaagccttacacagctcaaatgtgttgttggcaagcgtatctctacgcttgtcggcaacattcctgctgtaaatgagtttcacgtcttcttttatagactgtagggtacgtgccaattgggaaatgaatgttttaatcccatcgtggcaagcggaatgttgtaccggcggaatatattgatgattgattttataggtattcccttgtctgcatacctctgccaccagcaaaaaattctggctgtagaacgatttgttgacttggttcttggggacgatatggagttttatgctcggcaagacatacgggtgatgcaaaggcacctcttccgggtccggttcaccgacaggtatcaagtgatacggatctacggatattagtaccatatactcgctgtcttcggcttgcaggccggattctgaaatggttgcactgggtttctcatccccgtataaaccgtcgtaataaacgatgggcagaccgcctttggtgattgcgttacaacttttcaggcggacacagagagtggacatggtatcacctgaaatctcaatttcaagattgtcacctatcccttcaagaacctctccaaggccatagttataactggtcaagctccttcctgcttcgcggttgagagcttccgtttggctatactggtttgcaaagaaatgcttgctggtcagcttcagaccattgacccagtttacaggcaaatatgttagtgttttcatatattatgatgtttttgtttctacttgtactcgccggatatatatcgtttggttattcttaatcttattgccctcactggtcagagtggggtcaagtattcttatgaacaacgggaagttaaaccattttgaggtatagaacatccatccgatttgcatatcttccttttctgtttcaatcttgttttgggggaaacgcctgttttggtcttcgataacccaattgaaccagtttccaagagatatttcattgggcagtcggacaaccagcgaagcgtatgtcgggtcttttatattccgtttaatcttgactttgaccgttcggaaaccgaagttgtctatgttgtcccaatatttccggtcaaaggttccatagctcaattcccatggggtgtatatcggatgcgggatgtccaggaacagggttctgctgtacataatcagatacgggattgcaaaccacaggatatttgttgtgttccatagcgaataaggcagcttgcttatcagttcaaacagcagatagtagcaccatccgcctaaagcgcatatcgtggttagagtgagaatgaccgctgttcgggaactgccaataccgattgctccgaacaaatcggaggttgacagtttgcagaacaacgccccaaggaggatataggacagtatcgtgaatgtcaagcctccccagacgtattcattttttaggaaaccgaacaggcagggtaaagcgacggcaatggaagccagaagaatgaatatgattaatttcttcaggctaagtttgctcttgatcgtttttattccggtcaagacaaatatcatcacggctacaaataatggagccaataaataacgtgcaaagaaatatagcaatatcttcatattattagatttttcataagttcatattatatcctaatcggttttctccgagtataaaatccgtttctccacataccagataatcaacttcgatatttcttgttgaaaggatgaaaaattcaagtatccggcggacattggatagatgcgtttttacctcctcatagtcatctgtcggagtatcaaggatgattgtcgccgtcaaatcatcggtttcacttatcattagaccattaagacctaatgtctgtccgatacatccggaaccgactgaaaggtaaaccgtttcatcaatctcatggacttccagtcgcagtttcaccttcaatcccaaaacgataaggaacagttgctcgatagcgggcaggttctctttataccgttctgcattgcagaggaataggaacagcttatatttctgatggggagtaatggatagctcgatattttccattacttcaatcatcttgatgaagttcttcttggagtccgggtcggaaaagaaattcagatggcggttattgatacggaccttttctttgaaaaattcagtatcaaagggtgcaaagaattgaatcagctctttgtcctgtttttcattggctcggatggcttcgactatctccttattgctcatgcccggtgtgctaagcaccaagggatgaaatagtaattccggcaattgatggtagatgctgtttcttgccagattcagcaatatatattctttgccggcatttgtcgttgcgacatgctgttccgaaacgcttaatacatctctggatttcacacgactgttcataccatggcaattaaccatagtatggtccaacagccgccggtcaagaataaattggagttcatcataaaagatttctgcgacgaaatttattgcctgacttcgttggatgctttccaagggtttcttttgcgctaacattgttcccatatcagttctccgtttcgatagtttatgacgatgttgtcacccggcctgatttgctcagagacaatcagacgagatacggacttcttgatataagttcttatgactcctgcaatcggacgtgcgccgtattttggagaataccctttgtttgccagatgttgcaatgcttcatccgacaaattcaactggatgtttttctgtttcatcagttgttcttgcaatcttccaaaatggaggttgaatatctgtttggcgacattttcatctattggagcaaacggaaccacctcggtaagacgtcccaaaaactcaggtcggaaatactgtgccataacctcgatgagctttccggaatcaggagtatgcccggattgtatttgttccacaatccactggcttccgatattggaagtgaaaatgattatggaattagagaaatctccttcccggcccagtttatcatgtattttgccttcatccatcatttgcaggaaaacatcataaacactgctatgggctttctcaatctcatcgaacaatactaccgaataaggtttctgcctgatttgagtgaccagcagaccgccttcctcatatcctacatatcccggaggtgcaccatacagtaatgcagccgaatgttcttccttgaactcggacatgtcaaatctgatcatggctgattcgtcatcaaacaataactcggccagtgattttgtgagttctgtttttcccgttccggtaggaccaaggaagaagaatgaacctataggcttcttggggtcgctcagtccgctgcgtgattctataatggcatctgataaagtcgtaatagcccggtcctgtcctttgacccgctcttgcaatttgctctcgatgctcaaaagccggtccttctcgcgggcttgtatctttccgataggtatattggtgcattccgctacaatcgcttctatttccgaagagcgtatctcttcaatggactggtcggatagcatctttagctctttgatgatgcccgacaaacgtcctgcttttatcgtaatgtcatcttctttgtcccacacatagttgtctgacagtttggtagtcaacacgacactgattttgctgaacacagagcggtacagcaagtacagtggtccttcagatattttttcgtcgagactccttattttctcaaaatccgtttccaaatcagatatactggctcgtgcgttcttattgcatagtcggacggcagcggcggttcggtcaagcaggtcgatggcggcagatggcaggcttcgctccttaaaatatcgtttggagagtgcgattgagtctttaatacacgcatctgagattctcagctcgtaatagttttcaatcctttttttatgtaattgtatggcattttccagtgtagtcgtatccagttcttcaatctttatgatgtcaagacgcccttctatcggatgtttttcgatgttcttccggtaagagtcgttcgtgagtgtgagaacaagatttgcggctccctcgctgatttgcgcacttaatatgttgacaagcgtggatgccttgcctgatgcgctgttctccaaaagaacctgtaaatcatcaatcaccagcacagcttgttccaattggttgagcttgtgcatcagattgacaactttttgtgctatctccgtttcagacgaggttgatgcgagcaattttgccgtattgagtccgacaatagatatttgctttaacatctcgtcttcattctcacaaatatctttgacaaaggcgttgatgatggaactctttccgataccggattcaccgacaatcagtatccccttgttctctgatcgttcgaggcattctaaaatagtacggacctctttttccctaccgacgacgaagccaccggcattgatggtttcttggtttttcaggttgtcggcataaggaacgcttgctgttatctgcatttcctctccctgataagaatacaacggggtaagggcattgtagtgggacaatatgtcattttccgaaatatccagcatctctatctgctgatgcgaatacacgacaccttcacgtaatatggcggtaaacacacagatggagtctatggaatccgctcctaatttaattttagaccgttcggactcatccaagactttcgacagttcttcgtcaggttccacttcttctgtggaagtgccactggacctatacatttcgcgatgggtgtcaaaccattccattatgtagccgacatccttctgcatcgaggataaaatttcttttaggcccgtgttttctgcaaacatggccatgacaagatgtgacacgccgaacgtgttatgcttgtcttgaagtgccattcctcttgctatcttaagggcagacaccaaacttggactataattgctatcattcatacgaatttgattttatagtttgaattacatacagagcgttcagtcaaatctttttcaagataatgggccaattcttccagattgggaatttcatctttatcaaattgtccaagttttatcttgatctctgtcactctgattaatccttttttgctgtcaggagatatagccacgccattgccgacttcgactgattcaacatattttcccagcttgtgcaacaggtagcttttgatgtcttctttagatataatccgttcccgggacaacagaccgtaccttaaactatttataagttcctgttcgccatcatgcgttgttcctccttgcatacaagtgcgcaacatgatgcccgaagcatcatatttttctatgttgaattgttgtatcagtgtgcgttcgttgaaaccgttcgccagagatccggaagttacccaatattttatctcggcattggtcgcatctttttgggggacacttaaaacaaaggcttttattttgttatctccttttagtgtggcctccaatcctctctctatatcatttatcttgttgaacaactctttgagctgcgtcgaaagtgcatccggattcattgaagcgaaagcactcccgtcttctttcattaattgtaatacttttgaaattaatgagcgggcactgtccgaatcaaatcgttcaaggtcgccaaaatacaggctgaatatacctgttggattttcttcatactggttcagccggtttacatattcccggcctttgttgtcttggaacgagcgtatgttcaagaattgtgtacggctcggacatttcagggggataatccgtccggtggaacggaaattatgctgtttgtaaacgatttgtctgtttacaaccggaaatgtgttcaaatatacttccagattttcaagactttctttcgtgaatatttccggaaaggctatcttgacccaaaagagactctcagagtcatccgggatctcacagtcggacgcataaccgggaaacatttctcggtaggtatgtttctctttggaagcgtttcttatattcacattaaaatataggtcactataaaaatctcggatttcatcaaagtagtgtgcattactatatggatcttcaacatgaaggcctgtttttgcattcagcaggtttccagtgcagtcatagaagaaagccatattcataaacggaagcagccccgtgtcggaaggcttgatgcaaaacattacagagtccattttttgcaggacttctttagacacatccatcccgacccagacgcaataatccgctatccggtttttagggtcaaggaagcgtgttggagtgctaaagccatcggttgaatgccttatgctatcgttatatgcgattgctctgacttttgcgtcaaccagtttataggaaaacaaaggggttataaagacttgaatatcacctttgccaaatatgttcttctctgcataaaaatgatcttcggcatcaagctcgcaacattccccatgattgggggtaatagtcataagcgcatgggccggctttggcagcgaccatttgtttcctatgagtattctggacagacggtgaagtatccgtgagtcggactgctctatttcttgatgcagtttgttggactcatgggcaaaaacttcaagcagcaaatctatcacggggtccatatcgcgtatatcggatacaccccagaactccatagcctgctttaatattcgttcctttattgcaatttgtttcttgtctgccatagttcgattattgtgataaagggcttatatataatgaggtattgaaattgaatttctcgttggttctatccattgttccggtcacggttatttgtgcctttcttcggatatgagataccttatctatattttcttcttctatttccaaaagagtgacgttcacatctacattccgtaacctcttttcatatttctctatcgtttttattaaggagttcttcactccttcctcccaatcgctgattttcacaagttggttgaactcaaggtcccatatcatggaaccaaagtcttctcgcccgataacttccccatgatgagaaagaatcagtagcatgatgtgttgggctatcgattcctgataggaacacctttgcaatttcttggcgacagccgattgcaattgtaatggcattttcaggtaagtcatactattcttttctttattctatttcgcaaatatactattttcctcattagatgccaataaaatacccctaaaaatttgacggtttcagaaataattcatatattgcgcacggtcataaaaccaagagagagctataaaaaaagtatgatattaaaaagtaaatgctatggcaatctacaattatggaattggaggcaacgaagtaaaagtcgatgcgaacgaatccatcgcggaaatcccctccaaccgaactttgatagttcaaaagctgacagatgaagctcctgcggctccggaaagtgtgtatggtttggaaaccattgaagatgtgttccaacgttttgaaccaacagttgacttgcgccacgtggatgcggaaggtaatgaaatcaaggaaatcatgacattcaccggactcggagacttcggggctaagaagattaaagagaaaagtgatttcttgagtaaacttgatattgagaaagagcagggtgtccgaataactcgccagcttacttccaaccgcgctttacagaaagcacttgaaaacccggaagtcaaaaatgccattatggacgtgattgaatcatcaatcgaggagattctggcaaatcaaaagaaagtagaactttaatcttttactaagatgaagcaggaaactcaacaacagacagccagtacgacaacctcacagaaagtcgtatcacaacaggcgcaaaagtcatctgcatcggcaatagacaagctcaaagaatttggtggcttcgcttttcttgaaaatatcatagatggatattccaatcttaatccggcacgaaaggcccgtcgcaacatcttcctcacggatgaacagtgggaaaatgaacgtaaggccttggtgaatcgcttaagcgtatggctcaaactcctgcgtgagaatgacactgccgaacaaatgcgggacaaggccaaggaaaccgcagaaaatgccgagaaccttcttaatcataacttgaagaatgctcttgccagaacacgggaactcgaaagcgcataccgcactattgcgctcttttataagaacacggaaagtgataaggtgaagaatgtcaccattgtcaatgcgaccatggagcagcttcaggatttggacaataccatttttgctgaccacatcagcaatgaactcaaacagaattttgaccgtcttgacctgcgtcgcaactactcgttgcttgtcgttcccggatatataggttcaaatgccattttggacaagtggtccaagattgcatacgagaacaaggcttttcttgttacagacttccaaaaccttgaaactccggacgatgtagtagatatattcttcaatgccaatcatacgggtggagatgtattcaaatcgaatactataatgacctgtaactggttgcttggtcgtcaaagagaggaaagcgttggagaagaagaaaacctttatattccgccatcttcttcacttgccgggaaaatatacaaaaccttaatgtctcaggtagtagccggtaagaaatttggtggacttaatgaagtagaaagtgtacgcttcgaccttcgcaagagtgagatttccgaacttgaacgtatgggtcttgtgccgatggtgaacgagtacagcaaggttatggctttctctgccaagacattatttaatggagataaccttggcttgcagacctactccgtagttcgtgtattcgactatataacgaaagtgctgattgacttcctgaaccgtcgggcatttgagaattggactactcgcacggaagctgatttacgtggtcaggttgtgaaattcctcgatagtgtaatgggaccgaacaaactcatcgaacgcttcaaggttatgaagattgaacaagacccgaatcagaaagaccatgtgcttcttgatatccacgtcacaccgtatttcccggcaaaaagcttcgtgatacagcttgccggtcataaaggcgataatccggaagatgctatttgggaaagcgcatatcgtcaagaataaattggataattttgaatttacagatgggcataatgtatgtccatctgtaaatcatttattcacttatatgaataaagaaaagaaagagtatcggataagaagtaggtgtccgtaatcagatgagtatcctcaatagcgcggcgaaatcggacaagctcttgcacactttaatgtacaagtgaacgagggttaagccaaaggagccatactcttttagtctcatgctataccgtatattcacagaaaaagcattattatgcagcttgccagtctaaggattggttgctctgaaggtacaatactggacggtaaatatcatcaagaataagtaaaacattaacgagttgtatatttgccactttagacaaatatttctcgttcatataataaaaaaggtctgaaatggaaattactttgcagcaatttgaggcaatgtgccaaaatcgacaattacataatggttatgttgaaggtttagggtgtgtattttggcggtctcgctatgtcatatcatctgataccacatctactgaatcattttccacacctttctatgaattggtagtgataaaggatgagaaaaatatcgaaagtggattgcaaccattagaggggctgatagacaagggaactactgctttgtctttatatggtattgcaaattcttttgagcaattatcccaaaaacctattgtcattggagaaaagtatattcagataaacagacaaggtactttggttcgtaatcccaatagagtatatacaacaaaaggtgaagttgcgaaaggtgtaggtaggaaaatctatattgcagggcttgttattgatacagcgttatggatttctggtaaacagactttttccgaggcggcattaaatatgggagtgaacacgggcatttatattatcggttcttatttccctccagttggaattgctcttggtattttgtggttcataaccagtgtctcaaaacgtccatatatttccccaccaagttatgaagaaatacatggcactattactcccgcagatgcaacaagagttgaacgtccttattattgtgaaccaatgagagtcaggcccaatcataaaaaacatatattaagacaaggaaaatgataccataacacaatgaatataaaacgtaatacatcctctttcaaagaaaaaaatggagtttcatttttcgataatatattttattggatttggactactgtaccgtcaaagggatttcctgaccgttcttttgtagttgttacggtatgtcaattttcttatgtgttgctttttgtttctattttgttgactctatttgatgaccaagttcaactttgcatatatgacaaaccagaacctatagctattcccatgcttatattgttgataatattatcttttatcaatttaaaaatatatgatgagcaaaaatatcaaaaattggaacatgactttagactgatgtctgttccacaaagaaaaaaacataaaaatattttttttcttttcttgttgactaccatattagttatattagttgatataatgcttctttattcttataattctcatatgaataatctaacatgaagttttcttcgtgtagttagtgctcttttttcaaattggagatttttcccataatatagcaataaataaacaatttaatacgtctattatttcagaaaatgacagtgaaataatcatcaattccaaaaaacaaaaaaaatatgaagatgataagaagagtttttgcagttttatcggcagtgttttgtttggtaagttgtaataatgaatctaaacgaatgcccatttatgttgagccgtggtataattctgaacctttgacaattcaagtggggaagtttagcgatgtgctgaaaagtgaagatgtaaaaaaactgcaaagcacggctgatgtaattcgagccgaaatagataatactcccattgaaacgctctatgtattggcgattagattttatgatttagggcaaaaagatgatgccgtttattggttttatacagcacagttccgccgaaatctttacgcccgtatgatagaaaatgtagggggtgtaggagaacctgcatttgaatgtcgtcaggcgcaattggcattcaataaactatccgggaaatggattaacggttatgcaggtggtgtaccggataaatggcttgaaattcttgctcaagttattaatgaaggtcgcaaaagcggctatgtcggattggcttatcctaaacttacctttaagccagaaacagaacaagctgcggtagccgaagatatagcaaaagaattatctgaactgcgacaatatattatagataatcgggaagaaatggcacaagcccgtaaagaaaatggaatagaagggaaatattgattgaatctgaaaataggatatagataaacgaccataagatgaatataaactggtgaataataattcctattgttcttttattaatttatgctttagaattggctaataaattaatgaagatgaatatggaaaaagcaatcatggttgtagtcagcttattactttatatatcagcatgttgtgccaatgtgtttgctgacagtgatagaaatcccggatgggcatatttgctcggaggatggattgaaatctttttggtaaaatggccttcaaaacttttttatatggcatggctggctaatatcacttatggattttctattaatatgtacttgtcggggaagaacacttcattattatatgtacttattatagtcagtatattattggctatgcttccgttgttttttaataatccgacattcgtagacccggaacggggcattgaaagcactcttggagtttttcatttatcaataggttattatctttggataggtagctttttgactttgttattaggtgaaatcgtattgtttttccaaaaataaaatgaatagatttttaactatatatgtctttttgctattgtgtggcacggcttccgcacaacaaataatagaatggaataatttacagactataacggataacgcacggcgcacggtctattatgaaaaaggcagtaaacaaccgttgcagggagaataccgcattgtacgagggcttgacgaggagcgtgttaaactttccgatggcataataaacggcgattattttcgctatcgtgatggggtactgcgtgaatcgggcatatatgccaaaggtaagcgtaacggcacattcacggagtattaccaagacggcgttactctccgaaaggaaacacccatgcagcaaggcaagatagacggaactgtaaagacctattttcgtaacggcaaaatagaaactgaaaaggagtatagacagagtgtggaaagcggacgggaacgccgctttgacagcaagacgggtgagcagatttttgaatctcattatatagacggcaaaaaagagggtgaggaatgggaaatcttcgagaatgggcgcacgcttcgtagcaggactacacgacactaccgtaacggaaaacttgacggctcttatcgtgtggaatcaacacgggacggaaaaccctatataaccatcgagggacaatacaccgacggcgagaaatcgggacgttggaaacagtacaacgccaccgatgacacaacccatgaatgggatgaatgattttcttttttcgcaagttgattttataaaattgccaccgaaagttcgtactttcggaaaaagatgttatatttgtaaatgaaagagttatttgacagcatagcaacgcaaaacgctgaaattcgcactattgctaaatcgttatttctatttctcaaataattcgctaaaagtttatttctcaatcggttaagtcaaaccgagaaaaatctaaaataaaaatatttccttttactgatttttgcagatttatttttataacatactatataatagtgaaacagaaagaaaagaaagctcgaaataggaggacaaatgaacaaatagacaaggatgtaatatccgaacttgaaaagcttgtagctgaatatggttttggcaatgtcaatttgagtgcattgatgaaagctgcaaacatagaagccaatgtgttttatagaagatacggctcaatggaaaacctttacgacaggcttgctaagcagtatgatttctggatcaatgatgctattgacgtttccagcctgaacatatttggacctaaaaagttttttgcggaaacattcaaaaccctttataggagcttgtctgataacactgtaatgcaaaagttgttgctttatgaaatgtcggttatcaatgaaacgacaaagagaacagcagaaacacgggatattatgaatttaaatttgattgcgtattatgacaatctgtttaaaccggcgaaaatcaatattaaggctattatggcaaatctgattggcggaatttattatctgatacttcataggagatgcgcgaaaacctgtacaatagattttaatactcaggaaggggaaaaggtcttttttgaatggatagactttctaacagatgtcatttttgacaaactggaagcgtatgaaaggaacagaaaagcagctcaagaaatgttatctgacggtataagtgaatttaaaatatgcaaatacatgggtatcaataaaaatgacttgagaatactgctttcaaaataaccatagaaatccacgagagctttcaacagagtctaaaaagtacatataagtgattatggacttaatagtttaatcagatcattggagcaagggatatttgacgttagctgttgtaggctcttttataatttttttctatatatccctttgtataaggactgacagcctgctacaagaaaaatctgacacgctttgtgtagcgtgttacataaagtgcgtcaagttgttttttcaaaggacaaacacgaacagacttgaaattgcggataatgatataagtatatcactattcacagtttcaaggtagtctttgtatcttagtccggctgtccgttctccttttttattattccctgctttagcgtttttctattccttttttatatacttccatttatcgctttctgctgccgtgcaacctgccgtggattgaatttttccgcaaaggtaatcgccagtcccagtcgtgtcaatgccggcattctgccgcgagtgaagtgcaaaaatcttcctctccgctggtgagcgtatttttcctcttcagccttgccagattgttcctgccacctttggatgcagaaaaaatcatcccggaggtcgcaaacaggccgaatagagggaaaataaaaaatattataaactaaggtaacggtaggactaaccacctgccacaaaaagaatttattatgttatacgttcacacaattggtcgcattggcaaggattgccaggttattactggaacacacggttcattcatcgcatttgatatggcggtagatgactattcacatggaaacagcgtcactacttgggtaagggtacggagtaagaaagagaaccacattcgactatccgaatacctgaccaaaggacggttactgctcattgagggaacactgtcggcttcacagtggaaggataaggatgaaaactgccagattcaactatccattacggcagacacattggagttcatcaataccggaaagcgggaggaagcaacttcagaagcaggtagtcagacggataccacaagcgatgtacctgtaccatcggtagctatgccacaagagaacaaggaagacttaccgttctgatgatgtgcatatagtgttgataaacaacatatactaaatgtagtagttactaattatagtaaagtagtgaattacctattagcgaaagtagtatttactacatttagtttgttagtattttagtatagtagtaaatactataatactaaaatactctttttagcaaaatagtatatactaattatagtatttactaagaatagtattatctttgtattgcatataaagacatcaagttatggcaaaaattatagctgttttgaatcacaagggtggggttggcaaaacgactaccaccatcaaccttgccgctgctttgcggcagaagaaaaagcgtgtactggctatcgacatggacggtcaggcaaatctcacagaatcatgtggtctctccattgaggaggagcagacggtgtatggggcaatgagaggtgaatatcccttaccggttatcgaattggagaacggacttgctgttgtgccgtcctgtctcgacctgtcggcggcagaatccgaactgataaacgagccgggacgtgagttgatactgaaaggtttgattgcaaagttgcttgacagtcggaagtttgactacatcctgattgattgtccgccctcactgggtttgctgacactcaacgcccttaccacagcggactttctgattattccggtacaggcacaattcctcgctatgcgcggaatggcgaagattacaagcgtgattgagattgttaaggaacgcctgaacccgaacctgagtattggcggcattgttattactcagttcgacaagcgcaagacactcaacaagagtgtagctgaaattatcaatgactctttctgtgacaaagtgttcaaaacgattgtgcgggacaatgtggcactggccgaagctcctataaagggaaagaatgtctttgaatacaataagaactgcaacggagccaaagattatatggctttggcacaagaggttttgaaattaaaataaggcaatatgggcaagagtgatttattgaaagacagcatgaaaagcggactggacggattgctgtcatccacgaagaaatctccgcaaaagaaggaaactacatcggttaagacagaaaaagagcctgctgtacattgcaattttgttattgacaagagtgttcatacgcgtatgaaattccttgctattgagaagaatatgtcattgagagatattgtaaatgaggcgatgaaggagtatttggaaaaaaacgagaagtgaggtatgttcctcgcttcccgttcttttaagtctgtggcctttgttagtatgttatactgatatgtgttgctacatatcattcattgacagccctttgtatgacagggtataacctttgaactctcccgttgcacgcatgaaagcggctgctttcgtttccagtttttccatgtcgatattttcggccttgcgtttgacttcgaaaaatgtcgctgtatcgtccagttcgttttcggctactatgtctatttcgttctcaccctttcggtcccaccagccaccaatacgcgtatagacttgccgttctatcagcacacgcttaaagtaacgttcaagcatcagaccgctgaaagtttcataatcccggcctataatcatcttcacactcccatagttctctatctccagcatatagctgtacttgtagatgaagcggaaccagaacgtgaagaaattgtcctcgatgatataccggacattcttggcggaatttttctcgaacaacggttgcttcttcgatatgatttcgtattctttctccagcttggtaagatagccgccgatttccttgcctaccacgttctcgatttccgaacgggatgtttttcctcgtgcaatggccgacagtatggaaaaatagattccgtaatccttgccgaactcttcgataagaatcgctttaccctctcccaaaaatatggagtcggcctttataatctggtcgagcatagccgttttagttgttgctcctgcatccacgagtagttgcacgtacttcgccacgccgcccgtgaaagcgtacaaggccagcagatcttccgccgtgtagccgggattgtattccgaaagaatatctttcagaacagtcggagtaaacggatgcacagtcataaagcgcgactgccggttatacaacggctctttcttatccttgaatatctttgtcatcatggaataaatcgaaccacagacaatcagattgatgtgtgacttcgggctgtataggtcccagatgcgctgcatatcgctgaacaccgatttgttcacacggaaaaactcctggaactcgtcgataaagagcgtgatgggacgttctgccgaaagtttcatcaggaactcgaacacatcggtgaagtgctcggcccgtcccatggtggggacacctaacttgtgctctatctcaagccggtagtcctcacacaaatcgccttcagctttccgggcaacaaagaaatagagaatcggttcgtcctcgtatgccttccacacgagtgatgtcttaccgatacggcgacgtcccgttaccactgtaaactgagcattgtcttgggccatttcgcgaatcttgcgaagagtggctatttcttctgttctgtcaaaaaatctcatattcttatcctttcttattgccgtttccgaaatggctgtttccgaaacggctgtttcgctactgcaaaagtaatgcaaatttccggtaaaacaggcaattgatacagatttatttagtaaaatggctcaaaggatttttgtctggtaagctccattcctgttttacaccgtctggtcttacgcccttccgcttgtcccgttgtatcatttatcatccctttgtagtcccatcggttttactatccgcctttcggcgtattcttccttttctatattcttttaatgccactcatccggtccattcctgccatcgccggttggttttccagacgcaaaggtggactgccgcgcttgattccgtcgctttgaagtgcatttcctataaaattcttcctttctgcgaaagagtaattttccggaaaaagcgtcggaaatcgcttattcgtcagtccttgtaaagcatctgtaaatcccaagcggttcaggcagaaaaaagaaccgaacaaagggaaaataaaaaatcaaatattaaaccaattaaatttttatgattatggaagcgacagcaattcaatcagcagagaaaaacatcacaatggtagcattggcaaatgtgcaaccgagtaattacaatccacgcaagaattttgacgaagcgagccttgtggaactttccgaaagcattcgtcagcagggtgtgttacagccaattggagtacgcccgatagaagacaaccgttttgagattgtttttggagaacgtcgataccgagcctccctaatggcaaaattggaagaaattccagctatcgttatggaaatttcagacgaggtagccgaagaaatggctgtcactgaaaacctccaacgtaaggatgtcaccccgattgaggaagccaatgcctaccaaaagctcatagatagtggtcgccatgatgtgcagtctttggcagtgcagttcggcaagaacgagaactatatccgtacacgccttaaatttgtttccctaattcccgaaatcgcacagcttttggagcaggacgaaatcacaatcagcgtagcgagcgaaatctgtcgttacggtgaagatgttcagaaagatgtgtacgacaaacacctcaaagaagatgcactgcatcatagttggcgagggatgaaagctaccgaagtcgcacggaacatcgaacggcaatataccaccgatttggagcggtacgcatttgacaagaccctctgtctgtcctgtccccacaatacaaataatatggtgctgttctgcgaaggtggttgtggaaattgcgccaatcgtacttgccttgcagaaatgaatgcggcatacctcacagagaaagccgtgcgccttatggaagaacgtcccgatgttcctctctgtcgtgaaaatactaactacaacgaaatcgtagtagaacgccttactgctatggggtacgaagtggaacgtcttaattgttatgcgaaagcatatcccaaacagcccgaagcacccttaaaagaggattacgatactgccgaagaatacggacaggcacagagcgagtacgagcaggagttgaacgattacacggagaaatgcgaggaaatccgtacccgatgtgaagcaggtgaaattaccctctatttccgtgttgagagcaaggatattgtactttgttatatgaccaaagttacctatgcctctaatagtacaaatcaagagcagacactttctccaatggagaaattggagaaacaagacaagcgtaacaaggaaattgttcttgaaaagactgtagaggacaccaaaaaacagattttggaagttgatatgtccgagtgcaagtttgggcaagacgaggataagatgatttatttcttcttgttatcatccctccgcaaggagcattttgaagcggtaggtatcggagaaaaaaagccttattgccaccttacggatgaagaaaagataaacatcatcgccaacctcacgagcaagcagaaagcgattatccgcagggattttctaattgctaatttcaagaacgcatacggcagcaatgccattgcatccctcttgcttgacttcgcacaaaaacatatgcccgacctgttggcagacatcaagaacggacataatgaagtgtatgagaagcgtcaccaacgtatcgaagagaaaaaagccgttcttttggtgcaggaacaagcaaagcaggaagcggagcaatctgacaaacagcaatccgaagtagggatgcagaccgaagaacagccacaagaggaagatattgcagcttaaccataatcactaactaacgaatagggggtagagtaatctgtcctctattcgttcctaattcaatgaaagtgaagatgttcacggacaactgctccaagctgttgtcgggcggcgcgtctgtcgggcaaacccgccatccgcgcgattatgccttttctattccatttatagctacctcccgatgccccgccgccacccgtctccatttatacctatcagtttcctcctttttatcttattccttatccggtccattcctgtcctcgccggttggttttccagacgcgaaggtggactgccgcgcttgattccatcgctttgaagtgcatttttataaaattcttcctttctgcgaaagagtaattttccaaaaaaagcgttggaagtagcttgttcgtcagtcctgtaaagcatctgtaaatcccaagcggttcagacagaatatagaaccgaacagagggaagaaaaataaatcattaaaatttcacgacaatggacaacatcaaagaaagcaaagagtacaaacttgccaaagaatgggaaatggcagtgaatagttttagtttcaatcccaagcgttttgcagccgctatacctgatatgcaccccacactgcaacagagcctctataggttgtttaaggagtgcatcattgtgatggcggacgagacacgtctctatgatgaccgcaatcgtgcatcacatgaagaagcaaagtgtcttatggaatacctcaagacaaacggaaagcatatcccattaaaataataaaataacaagcgtatgaaaacacaagaagtacaatttggcggcaataactatccttgccgtgtggtggaatccaacgagggtgaagaactccttatcggctcgactaccttgctcgatgcccttcagcccggtagtttcaacgatgaaaatgaaggcttcgcaagcaaggaagccgaaagaatctataacgaggttttcttctttaccgatatggcaaacttacgacttacagacgtagaactggttgccgaactgaaaaaggacaacccggaatggttcgaataaaaaaaacaataatcatcttaaaaatagcacagttatggaaaaagagtatgtaatgcaaatagcacagaccattaaagagcagttaataggacttacccctatgcccgtcctcatgtcatggggtatctcagagtttgcagccaccatcttcaaagagctgcctgcacttcgtatcaaagtaaacggactgttacacgccggatacgttattattgcacttaatgggtcagattattatgagatatatctgttgaaagacaaagatgtagagtgtgtcaatgaagaagtttgtttcaacgagttaggggatgtcattgacagggcaattgaatgcggtactgacaaagaggaatacgaaaaaatttgccatcagcaactcaccaaattattaagcgggcagttctcctgataaaccggaagaagattagtagtaaaccgtcagtacgattgtactggcggtttttgttcttcttatatcagacagccggatttttatttcgcgttacgcttgttctgaacgtcctttatcatctctttcacatcttgtcctacttgtacaaagtttttgtataggatgcgttcccgttcctctctcgacttgaaggtgtagaacttcggcagcggcacatacgccgcttcctctttcttgattgctgccatatcaaaatctgttttacagaagaactttgtagtcttgaactcttccgattcttgaatattcattgaaccgcccatacctgttttcgtcttcacaaaatcccgtgccgtctgaccgcatatccatccggttgccatatccgagattttcgaggcaggcacaaggttatccatattttcattgagattgatacttgttttgtcccggtcaatggtcacgccttttttgacctgtaccaccttgccgaagatgtcattggacaaccattccagcgtttctttggcacgtgccgagccgcttaccacattgcctaccgtcgtaatgattttttgcatacctaccttaccataatcggcttccagttgcggtagttcctgaaagccgagcgttacactcaccttattgcttcgcgccgtacctatcagacggtctattttgtgaaagtagagtgtcggtaactcgtccactataatactcacgggaatatttttcccctgcccggtattcacacgggtaacgaggcggtttaggataagagcgttcaatgcgccgatgatggactccatttccgggtcatttgcaatcagcaggtaactcggattcttcgggtcactcaccttcaggtcgaagtcatcgccatcccggtggaatatccagtagctctctttggttgccagacgcgaggtataaacacgtaacgtgccaatcataccctccagttgctccattgccttatttttgaaagctgtctggaacgggccaagtagcggagcaacctcattgtcagtttccagtacctcgaaaatcgtctgataactttcattcaagaatgacagaatatgtggcatgtccgaatactttcccagccagtaggcaggttccacgatattgccgccttcacggtcacgcacgatacctgtcggtttccagaatttggtctgcggatcttgctgtctttccgcatatagaggcttgccgttggcatcgtagggttcacgctcataattcacgaaaaagtatatacaggcggcaaggaagtttaccgccgaggtttggaagaactggtcgcttccgccgccgccctctttcttacccttttgtaggctttccaataatgtttccgccgtttcgctggccgccgcgaggttgttgatgtactttgcctgaattggattcacccgacggctgtactccacatccacaaaattaatcatgttgaacttacaccctttgggtactctgcccagtttctcgttcctcttgtaatggtagtagagcttggtcgccaatgtcggaaacttgtagtcatacaccaccatggcgaaacctttggccgaatgctgtcggataaacggctctatgatactgaaagtcttgcccgaccccggtgttccaactacccatgttcctctgaagcagttacttacagaaatccatcccttgcggaatttacccttatagtagtaccgcatggggatatttacgctgtattcattctcgactttttcctcacattgttcaaaactttcattctcgaagttgaaacggtctttcatcagtccctccttgatgaacttcgaaatgttgtctaatgcaatatgtaccagtactacgccagcaatggaggcaatcatatagagaatgatattcaaaggtaaggtataaagccttgttcccatcgtatggccgaacatccatacggagattacgagcagcaacaacccgctcgtcaatggatacaccacctgccggcgtgcgttgaactccagatgcttcttgttccgcgttccgacacaagtgatgcagataagcagtaccgtcgcaattttgctgtacacaagattgccgtcgtggtaaatcatccattgtttgatgcgtccgtgaatgtcggtcagtatgccgccccagtggtcgagcattgcagggtcaatggcatattcaaagaactccagtagtacggacacatataccactgtgcggaatatcttatagaacccttgcaattccttactttcttccataagtcagtctgttattaatccctgttttatacgataccaatgattgcctactctgattacatccataccgaaccatgcaccattctcattcagttttgtttttatcttttcgagtgttaccggaccgacaccccatatttccatgagatattgctcgttaagatgaatcaggtctccgatatataatattccatgagattcaagatggcttttgatggatggggtaatacccaaactgaataccggttccgagagatagtgtacttcttctgcttgaatgttattcaaggctatttcaagtcccactttgattcttttgagagaatcaaggcgttcttgtatcttttggatggcaagctcgtcttgctgtatctcattgcgtaactgggttgctctctttacaagttcggcattacttcttttcaattcttcattaatatccgccattgacagattgcttatttcaagttcgtttcgtgtgtggtccaattgcgtgacaagttcctccagtctgtcggcatgacacttcagtattgaatttttttcattatcggcagccatttcgtccaaaaggtagccgaaccttttaatttgaaaattaatattttctttatccgatgctatggaatctgcgagttttgccagtctttgccggcatgaattacctttcatggacttatacatgaggacaattcccaatatcatcaacgctatgctgaaaagtatatccgtatctttcatatctttctatcctttattcgtttatggtaattatagggcgtactctgtgcgcctgtactttaggtgtttcttgcattgcgccgctccccatggaatagagccatgccttggctgtctgttgcttttcgacctctgtggatgtccagtaccaacagtcgttttcatccagcggtaacggctcgccgccacattgttcgatgacagggttgactatctctctcatggtgtagagcagccgcatctctgccacggacggtacataggcactttgtccgtaccgccataggtcgaaaaccgcttctgccattggcgaagccgtttctcgtgtatcgtacagtgcgaatgtattctcgttgccatcataagccatgatgtcggacgatgtgccttgtgcgatgccgaggctgtcggcgaatgcctgtggagcaatgtcccacaggtaaactgcataaccgcccccctccgtatctccgcgttttccggtatcgaagacaaccgctatcgcttttttccccgattgttcatattgtgcataaggcaaggccgttccgtcctcgcagaggatatgtcctggacggaccgctgtatcgggtacgtctatgtgcgtgtcacaggcagcgcacagcacggcagccgttgccgctgccaccaaatgtatctttcgtatcatattgctttctttttttgtttccctatttcataggtagtttcacacccagcacgacacctgcacgcagcacgtccgcaccttttatcatcacatcgcttttcacttgccaatacagtgtccatccggcccgtagcacatagttgtgttcataaccgaggtgcaggccgccgaggaatttattcgtgtcgcttccggctgaagctccgatacgcagactgccatagtggttgcgtccccgcgtcatgcacggcttgtaggccacgccaaaaccgtagctgcggtagtttcgccaaaatgattccggacagatatgaccgcacgagccgcactctgcccattgtaggtagccgttgacgaaaaactcccacgcatggcggtagttcatttcatgttcgtaggcgagcgttatatccatgccgttcttgtagagtagccctgtgtcaagtgagaggcgtccgctaccttgttgtgcattcgcacttgcagcgacacacacgcaggtaattatcaggatgattgtctttttcatagtcattcctcctccaataaatctgcatggaacgaatctgccgccagtatatcctcatagtcgatgttcaggctgatgttacggccactaatctgtttctccgtcatttcgatggtcagcagcttgtcattgggaaaggtcatctttttcacgacaatcacattccgatagccgtgtctgaacgtcttgcccggttccagaaccaaggcaggtgtcagttcaatagtctgtgcgttggttgccttggcgagtttcttgtctgtcagttttatccgtatctcatcaatgtcaaaacggatgttcgtcttgttctcgatggaaaagtctatgaagaagtagttacccaccgagtagatattgttcagacgcatcaccatacggtgtgctttggtagctacgttgcggattttcgcaggtgagttccagatgcgccgtgcatgatgtgtcatgtcggcagtggacattgagactgccggattgttatacgcattacgctcttgcagcagtatctccttatccgttactgcctctttcatccttgtggtataaatcagtgcgtattgtgtgcggtaccgttccgttacaatggtgacgatggcgagtatttcaccatcctcgtgtccgctttccttgggctttaggcggatgatgttgtcaatgggctgatcacccgccaccttgtcagtggaaatatccacgaaacgcaccggttccgatgccgttatgacggttgttatctgttcgttcaccgtcagttgttccatttcctcataggtcgtttgcgcctgtgcgttccgcgccagcggcagccctgccgccagaagaaatgacattgcgattttcttccaattcatatccatgttgttaattatatttattccgtttatttcctcttttcccttatttctcctctttctttacctgtttggcacgtacccatgtacaacgccccgtccgggtcatttggagttcacactgccaaagagtgcctttctccactgttttgaaattcacatttccgtatcttggtccgtaaaaaccggtatgtttttgaaaagcgaataaggcaatcctccgtctgtcttctgtccggaagttgcatattagggcaaactgccctctgtgatgccaccactcggcactcacaagttttccgataaatgtctcggctttattgggggctatatagtccgcataataaagcccatccgtacctttgtgatattctgataaatctgtttccatgtcatcatcgttttatttccttttttcctgtccgttcaccaaatacacgaaagttccgtatttcagcttgactttgtttttcttgatagctttgctaatggcattgcttgttttctggtaggcattgttcaccgcctgcattccccattgtgcaaggctgtttcctgtacttcccatactcatgttcatattgcccgacattgccccgcttgctacatccttgctcgtttcccggaattggctgttgggtacatacagcccttccatgccatcagtatcatagagtgacagactcactttcaccagttcgtcattcacgaggatgctgctgatattacctttcacgcgtccggatgagaatccgctcactgtagcgtacaggtacgttccccttgctaccacacactcgccaatctccacatcgtcaagcaggcgcaacctcacgcgcgagccgtccaccgctttgatgttctcgtcaatgatggcttggataagtttcggttcacggacattcttcgacagtgtgttaaagtagtccgaggttgtcttcaccttgcgtaccacttcgctgggcggttcgtccgcagatggcgttttcacagcccggctctcttcgttgatggttccggaggctgttgctccttgtggtggagcaatgttggccgtgtccgtttctgccgggggtacagtcgcgttttgccctctcagtctcgcctctgcgagtgctttttccagttcggcaagtgcttcttgttctcgtgtcttggcagaggcaatttccgctgccgcagctttttcctgttgttcttccgtgagcaggtcgatgtcgtcctgcgtgtatttcgattcatactcttccttgtttttatcgggttcttcccggtctatgttatctactgcggagtagtcctgtatcttaccccatgatttcgccatattctcgtatttgctgcctatgccatcgtccttgatctgtgcccccggcaattcggggttcaggaactccgtcgtctgcaatgccttgtcttgtatttctatcgtttctgtctgaaacaggtcgaagatgaaataagacgcgccgagcagggggaaataaaggatggcgggaagcatatatttcggctggcgaaaattgattttctccaatatcttcattatacatcttttaattgagttgtacatacttgccttcaatggcacaatttctcagtatctctgcgttgtcttctccgaaagctaacaggaggctaccgcaaccgggagagtcacctcgcgttccgtctggtcggtagaatcggatgcggtggcgtaggaatttcattcccgttgcttttgggaagatgacgtcctgaaacattttggaatcacaacggttgaataataatgcaatgccgttgccatgttctgccagtttccggacgaatagctcgataagaggacgcgaatagggaggattgagccacacacgtccttcccatatctgggacaacccgtctatgttctgatcatacatgacctcggcagtcggccacaacggacggataggagcgcaagggtcaaggtcgaatttgcccaatgcgtccagtatctcctttggcgtgtaccattcgtctgacgaacggactgatttttcaaaccgtgtattcataagcattcttttactgtggtttgtcccctctgtttttatgttcccttatttcgacttcctgtaacagcttgtgccgttcccgaagtacagaatcctgcatttccgttgccgtgcgacttgtcgggctgtgcctgtacacagttaccaagcggtaggcgttccatgcgaaagctccgatgacgaatgtaaagacgatgaccagaaacagcgtccggtgcgcgttggcaaagccctgcgccttggccgccgcttggtcgatacgtgtcgccttggcgaatttgtgcccggcctgcacctctcgctcgtagcgttccttgtactgcgggtcatctttgtccggcatcttctcgccgaacaacatccgtttgaatcctttgatattcatatctttggtgatttaatagttactctttgttttttgctcgatatctttgttcagcaatgtgcgccagtttactatgagcagtccatgcggattgttgtccgttctcggcacacgtttaagttgccctgccgtaaccagttcgcgcatcaggatattactccgacgttcgattcgctgccgaccatagtaggtgaactccatattctttttgtcaaaggagatactgtcacagaaaatcgagaacaccgcgctcgtacccaatatgttggagtaaaatcccttttccttgagggtattgtattgtgccagtcccgtctcatcgaccaggtacatcgctttttccatcgtatagcggatgtatttgtcgtccggtgcgagagtaaaaaagtaatggtggaacatttctacatggctcttggcttccacgtccagcgtttcgtccatcgtcgtgcgggttacgagtataggtacatttccgtccagcacatacacctttttctgtgcgtccgtcaccattgtccgggcagtccagatacttgacacactgatgatgatacaccctacaagaaaagcagtgcagatgatgcccaccagtcggattttattctccaaatgcttgatgaccatatacctttattttttcttgttagacaatcgtgtgtattcgtcatgtaacattgtcatgactgtatcctgtaactccgtcagaaatttttcgaacttcccgtcaaagagctgtgtgtaatcttcccgcatgattacatgcacgaatatccaccagatacggcggtttcgattcttggcatttttctgcaatttgaccagttgcagacgataggtaaggtaagtcatcatagggacgatatatcggttgtcccatgtaacggcttcgtccagttcttcatattccggatcaattcggtggttaggtgcataaacgagttcttcgcttatgcgttcatttgcatagcgcacgaaacgctcgttcctgcaccatttttcaattttctgttgtacattcatcttttggatatttaatattaggtttatcattatctcatcatcgagccgataccgcccgtagccgtcattttggcctgctgcgccacaccttctccaaagttccgtgtagagaaggccgtgtcaccttcaggtatcatccatgctgccaagtccggtacgaggtttaggcatttcagtgccacgatacttgccgccatcaagtagccggcggagaagaagctgttttgcaagtaggccgccatcgtctgttcgcttgctgtgattgccgtcaggttttctatctgtatgcacaatacaatgtcgaatagcagtagcacatagaagccgacgaagtagagcatcgcaccatagaaatgtactgtcagataccttataagccacttcgcccatgcaccttcccatttgggcaacagcgagaacgcccattgtataggtccgaatattgttaacatgcccagtaggatttgctggcagtagatggtcgcccaccatccgatacgatacacaatcagagcgataagcatgatgattttatcgatacctacgatgactcctgccgtcagtgaggtaaaccacagttcggctgcgtctttctccattttcgtcacttcgtccactccggtttgttccatggtcgcttctaccagattcgggtctgaggtacccgtgtgagcgacatctgcctgtgcttgcaaactttggtacatcgtgtcacgtacatggataagttgctgcacttcctcgaatttgtccgctatttgggtggcttctgcctcgtacaggtcatgcgtgtacgagccgatgcagttcgggatgtaagacaggaagtcaagaaaacaccaactgctcccactgccagccatacccgtgtctgctggcggataccaccaacagaggatgattgaaacagccaaaggacggaacagcttcagtacatccagtggctcatgtttcaccatcatcttgtacgccattcccgctgccatcacaatagcgaacagggcagccagtgccatgcacatttgtagtatccaccagaacggtccctgcgagccggtaaaagtcgcatcagtcaggaactcgttcgtttgaaaaatcacatcgtctatctcttcttcaaggatattgataccgaaatccgagagtatatttccgtctgccatacgtttttgttttttcagttccctttgcttactgtttcatctccgtcaccgctgtcgcccgtgttattgcccgattgcgggccgcgcacggcaaagcgcgattcgtgccaccggctcaccgcatcgcggacaatactcttcttatccagagtacggtcagcggtagcgttcagtagcgtacttgttaccgtagtattctgccgtttggcaaggtagccgacaaggatttcgttctgtcgggttatatcctcgtagatgcgcagatactcttttttccgctgtgcgttgggcatataggcatctttcgttgcatcaatggcgcactggtagatatggtaatattccgtccatctgtctttatcctccggtgtccccccgacaggcaagatgcggtctatatttcgtttgaaccgtaccatctgtccgttgaccttatcgccttcggcgagccatgcgatgtccgcttgacggtcagccacgttcaaggcctctatctttgcccggctcaccaatgccgagtcgatggcttcagcttcatccgtttggttgtacaggttgacgcccgccagtgtgcggaacgacagtttgttcttggctgctgccgactttttgtacttgttgtgcagtatggaatagtagaggtcgggcgagagtgctcccgtaccggtttccattactgttacttgattttgtttcggcgaatcgtggttataggtcacggattgtgcctttgccgccgtggttgcaattattgtaaccgtcacgagtaagagtattctgtccatatttactttcggttattttgttactaatctttcaatactcaatgtgcttcaatcagttaatcaccgagattattccacatttctttttatattatattcatttctaatcctttcctctccccgcgagaagtgcatgtcatccttttcaatacaaatacattttctattcgtatgaatacaggcgattgcagtgctcatgcttccagaggcaaaatcaaggactgtgtcaccctctttcgtgtatgttcttatcagatatttcaataatgcgactggcttttgattaacatgaatcgttttgccctctgattccgcagttttgaaatatttcacacttcgtgggtatctcgttcctttgttttcatttctgaatgtaggatttggtaccttgtttactcctgtccagttactccctctctttgtacgattttcataaggctcaccttcttccatgattggataataaggagttctgccgttacaaaagatactgattagctcatgcgcttttagaggttgctttttagcaagaaggaaattgcttgcttttgacttttcccatacccagtcatatttaaattcggctaaattgccacagcgtaaaaggctgctgaacggttcgctgccaaataaagccgtaggtgcattatcctttctcacccttctaatctcctcccacattttcgagaatggtattatcttatcccattgcgaagctgtaattccaaaaggtgggtcgcatagaactaaatcaatacttgattctgggagaagaggcattacttcaaggcaatcggctttatatagcgtaatgtcttttgcaaaaacgatctttttcattacatcttttattaatccaaatgtccatttgcctcttggttataggccggatagacttgtttgtacttaaagtttctttctctgtttgtacttctccgaacatccaggacgaaacgcttttcctgcgttttaagatattccttagcaatttcggtgcatagaagtcataatctaacttgtggcattatttacctccttcctcttttaccgtcaataatccagtcgtcccgcattgcgccaccgtccgaaagcaccgtcaataatttcccgtttggtacgttcccggtaaatcttcgatttccagtagccgatacgtacctgtatgtatctccatgtctcgatgtatgcccggttcaagtgttgctcaatactgtccagcgacttgttcacggactccagtaccatcagcaggtcgctggtcgagcaggccgctgcgcccgtggcatacagcacgaggtcgctcaccgacttatagaggtgttctccctcgttggcgatgtcccgtattgccttttcattgatagtcagtatcagtgcgtctgacggctcgatgttcccatgtttcaggattttctcatggaaagcctccagcatggtcttatagtcaccgatacggtcacttaccgaactgtaggtatccttcacgttcagcaccgtccgtagggactggtacatcacgtcgatgacatcaaaggcacgggtatagcggtcaaggtcgatattcacttccttgtatttgcccgtctcctcacggctgtactcgtgcagcagttggttgctgtattccagtgtgcttcgggccaataacaggctgcgttgtttcttgtggtcgttgatgtacgcttccaccgacatgatatcgaatgtccattgacccttggctacattgggtagtagcgcaagcaacgtgatggctatcagcatagtgcgtttcatggtcgtacctcctttctgccacttcgggatgtccgtgcgttttctacccagcggtcatggcactcttccacgagcgtcagcctacgaccctcgtccgtatcgagttccggtagcacatccttcagtacgtcgatgatgttccgcttgtagtgcatcatcttctccaaggatacgaggtcggcgtatattttcgtgatacgtgaatccacttctcgtgcgatttcgaggcggtcacttgaccaaagcaggtggtacacgtcgctgttcggtacttcttccataggttctgtacgggcatactcggtagtgattttacagttgggatattcccgtgcaatttccgatatgcgattattcacgattttagtcttttcctcgttcggcaggttcggatcgagtgtcagtacatcggcaacgtgcgtgtctgtgtatgccgaagtcaattcccaactgatttggatgatggcacggtggattttgatacccagaaagtatttcggcttccgtgcgatagaaatagtcgcacggaacgtaatgataccattgatgttcggcatcgtcgccttacggacgaacgtatagccgctccatgtacctccgtcctgccaagtgaggctgtaggctgtcttacaatcctgcatgatggccggtaggcggtagtaatcatctgtcggcacatcgttctcagcttccgcttcctgcttcgcatctgcgtactccttctgcttttgttgccactcggcaagttcgcttttcagttcctcgatacgtgtccggttggagttatattgttgccggtaagctgctgcgtcttccacgctcgcctcggcaatttttttcagaaggtcggcgttttccttttccaaggcactaatctgagattgaagaacggcaacctgattgtccgcttcccgtatcagtgcgtccagttctgaaaggtccagttcgttctccgttaccgaggtctgcatgacgcactctttggagtgggcatccagtgagccgccacacttacggcacttgtattgtgtcgagccttgtcccagcgtcgccccgtctgaacaggttacactgatggtcacgctttcacatccctgcaattttgcggcgtccgtcgcctgataatagttccgtgcatcggatgctatgtaatagacatagccttcctcgttgtcattgaactccgagaggcgggcattgagctgcgctttgaacgtgttcagatccatcgaataggaatcgaagacatcctcatagactacctccgtccggttccagctctgtgtcacatgtatctcataggcgtatgccttcttggtctgcttgttgcctttgctgatgatgtaggcctgttgtcgggtattgatagtataggtgtaaccgtcgttgctgttgttgagctgttgtactcggcttcttgaccatccggcatactgttctgagttggcaagggcctgctcccgttgcgaagcgttcgggtaaaatcccggatcgctcgtattaaagcgtgtccatgcgcccccgttcaatatgctgttgtcgtctgtcggtgggtagtagtcgcatagagaaatgcttccttgctcacgccgtgcgatataccaccgttgcgtgtaatagttcccgactgcattgtccatgtagtcggtcatccacgatgtgaggtcgtagttgctgaaattgaacaatgcggccacgctgtcctggccgcccaccatgtcgattagcagactaccgatgtcatgttccgcctgctcgaagagagtaccgtagtgttcatacaggttgccgatttcattggctttgccgcccaacaggtcatggaacgcactgctttgcagtagagcgtcaccgaggttctccataccagatgttgccagccctacgcccatgttataaaggttgtcgatatcgcctttcaagttctcgatggtgaaattgcccggcactttggccaagttgtccaacatccgttgccaatcggtaccgcccagttctgcgaggttcagcaaactggcgatgtcgcggtcaatttccagaaaagcgatgtccgagaacgtcagtgtgctgttggtcacaacgctttcgaactgcatacacaggctcttcgtatcatcgcagactttcatcaggtaactgccccagtggatggctgtttgtggtgagcgtagcatcagtttcgctaccacccatattttcggcatgattttctccgccaccatatggtaaattcgacgatagtagtaattttccgtgctgctgcaccagatgccaaggtcggacagagccttgtgttccaaaaatttggaagaaaatatccctgctgctgccacctctgccgccgtatagtgtttcagaatatcatccacctgctcgcggtagtagctttcagccactacctccgtgccgaatgcggcggccatggccgccacggtacgtgcgtcatagttcacgctgtaatattgtgcgtgaacgtgctgtgtcagggcaggcaataggataacccaaaagataaacagccgtttcatcgtttcagacctcttttatgtattccggttccttgtgattgaaataccaccgctcagattcgatacaattctccgtgacaagtcggcagaacatatcatgtatgatggtagtatccttgatggcccttttgatccgggcttcttgggagccgaaccatctcaagaagaaaggctggtttagataagtttcgcgcacggtctgatagcgtagccatcctaagtcactcagtcttttttcactcatcggactgctgttcagttcccggaatagttcttcacgaaatccgttttcatcgaaggcaggtttgctgctacacagcctgtcgcacatatcgtaaaactccttttctttggggttttcttcataatatcggttcaagtacgtttccagttctacatcggacatacccaaccgaagggaatactccgccaatagccgttcgatggcagctaccttgtccggtgtcatgtcatccatacggagcaggttctccttggatagcatacaaaactcccggagggacaaaacagtgagttccggattattgacagaaatttgttcgcgcgtcaagctgctttcaaaccccatcatatttattccgtagtccagtgacagggtgattaaaatccttttcgttttcattatgatgttattttagtggttaagttcagtacacgtcccgcttcattaactttctgtgcaaacggcaatgccttgccgataccgctggcatcccagtcacggcaatatgcctcgatagccttttggtggctgcattgtagctcgcgcttgtaaagtttcagagcctctttctctgcccgttcagtcgtgtaggtcatgtagcactcgtgcggttcctccacgccataaacaccgctggtcgtgccccggcggataaatacctcgcggaagaagctgcgtccttccttgttttcgaggcggttgatggtgaaaattttcttacagtccacgtccgttaggccaagaatcgccttgatggtatcgaaacgttccttgaatttgctttggtcaagcagcatcaccacatccgagttgttgatgatggcctctttcacgatttcgctgccgatgatgtcctgtatctcctgtgtcaccacacctacactggcccagaatttacgtgccgttttgtacataaatttgatgtattccgccatcagcgggctggcgatggctttccacgcttcctcgatgacaaggactttgcggttctttttgatgcgcattttctgtaagaaaacatccatgataatcagcgtgaccaaaggaaaaagcagcgggtcatcttttatactgtcgatttcgaagaccacgaacgtctcgtcgaacagcgagctgtccatgttttcgttcagcgttttttcgtggttgccgcccaaataaaagtccttcatcatatagcggtatgtcgagaggtcgatgcccgtgatacggttctcctcacagatatccgggatgcgctgcacggaatattcatagaaagagttgaatgacagttcctccactttcagttccttgcgccgaccctctatctcgtcaatgataccctcgatgcgggccgcacgttcccgttcgctttcgtgccgcttctcactgctgttgcggtcatcaataacgaggctcttacgcaagtcctcacgctgttggggtgtgaagctctcgaaaccgttgaagtaggcgtcgtaatattccgtgatgacgtgctctatcagacggtcttccgtctttgtgaccgttccctgcgtacctttccagataagcaagacgaggtttttcaggaatcccgttttttctacgttcatctcttcccgattgatgcggaacggattcatcgtgatgggccgttcctcggtatagctaatatacttgccgccgaaatactcgcatagcccctcgtatgagttacccgtatcgaccattaccacgtccgtcccctgttcatgcaactggcgcacgacggaattcatgtggaaactctttccgctgcccgaaggccccaggcagaaaaaattcgagttgtcggtcagcttgttctttccctcttttcccgtgatgtcgatagctaccggaacaccttgacggtcagtgtaataaacttttagcggtgtttcctcactatgctgcacccgttccttgtacatcaggcataccgcagcgtcggagagggtcagaaaacggtcatattcctcgttcaggctgtaacagttgcccggaaacgaactgacgaacagttccagttggttgtatgcacgcttactgatgtgtatgcccatgcgcccaaaagcgttttccaagtgattcgtgcatttttgcaggtcggtgtccgcaggcacgcccaccaccatgttgaagtgcgtgtacacgagcagtttgctttcacgggctattacgtcctgtacctgtttgatgtcctctacggccatttggttactcggattggggatgcttgcgtgccggttcttctttttgtcgagtaatgccagttcccgcttctggctgggcaggaaaataatttggttgtacaccaccgtttctgcgttcggaatattatccaccaccgagacaagatccactggcatctcggtattattcacctcgatattggtatagggacgtatcagcgaggggagcgcggcgcagtccacgtccacgaggctgtacaccttacagcgtttgtcacccatagataccgtttcgtcgtcagccttgacattcgtcatcgagaccatacggtctttgaagttcatcgcaaagtaacggtccacatattcgcttgcctcggctttgttcaggaatttcacttgtacaccgctgtcgcgtagtaggtctcgaaccttataaattttcacgaggaaatcgcgccatttcttgctatcgtaagagaaaagacggctcttcttggcttcctgtgtgatagtcagatagcaaaggctgtccgtgtacggacgcccattaaaataacggaagtacgatgccgagagaaattcttgattatgctccggctcgttcgcgaactgtttccttacgaagatgtcttgtttgtgcaaggcatacccttcgcccagcgtctgcgcaagggcagagaatagatgcgtgaagtcgtaatagctgtcaatgtccgctgaatacttctgtaccggattttcgattttcaagacggcggaatattcgcccgtcttggtgtacagcacacccacaccgtctgtatcttccacagagaaatagatattctgaaagatatgcttgcgcttgccgcccgtaccgaacgtatagactgacaaggccatacccgtacatagggcgatgaaaaataaaatgatatatagggtcattccgatattcgttcattaaataggggcaggtctgcctcggctggagacggacccgcccgcgttcaacaatcaatcagccacacacattgccgtgatggtttttcttatagtcatactttatgcgaataggcatacacatacactccacgttttacatttttactgtgcagcccctttcgctgtttgaggatgataagcacgattcccgcagataagacagttgccaatacgaccagtccggccacaaagcccataagacagtaggcggcgatgaagcccacaatggccccaccagccacgcctgccgcccaatagatgtagcgaccttgtaatcccatcagttccaaaggccgttgcagtcctttgaacagcgggtaatccggataacgtccgttattagtcattcctccaggctgtttatgcgttaattccgaagaatagaggtaatgcttgggctgccgcaatcaggaaaaggcacgccccaaccaccatcataatcttcttcttgacatcctgttcctcgttgttcatggcgatatacaccgaaatggctccgatgatggccacaacaccagcaatggcatagcagagtttgaccatcacaggaacgtatttcacgatttcctcggctacggttgatagagctgtcgtaccggctgagtaatcgcctgccgtactttgagccatagcaggtatgcctcctaacagggcaatgattaacatttttactttggtggaaacttgcatgatggttttctttgcctttcggcacattcttttgaatttctgaaacatatttattacattttttgtggtacttctatttttgaattggttttacactcctgtcagccacctatatgcggtagccgaagaaagcggggaacacgattgaagctccaatgatgaagaggcacgcaccgacaagtgatacgatagacttcaccacaccgtcctcgcctgtgttcattttgatatagatttggagcgcggcaacgactacgaaaaccgaggcgacagcgtagcagatgtacagcacgtacagcatcatcgtcaccacgaagtcgtgcatcgttgcaagtgcgtctgcaccccaactgtagtttacgctgccgcttttggcgaataccgcataagggacaaagcacagtgcacataatattttttttgctttcgacattttacaatcggtctttgagaggtttccataccagttccggacggttgtccgtctttcctttggcaagcatcgctttgtacagttcgtctgccgtgtatgcgtccgacaggtaggtctcggtttcttccatctgttcctccgcttgggctttcagccgtttcagcttctccgccacggctatctcgccattattctctgcggtttccgtctcctgtggtgtaggtgaagcggtaggggcaacatctgtttcatacttctcattacccacattgaatcccgtatcgctctccgtcacggacacactctgttcatcttccggcgcaccgaggtcaaatacctcttcttccggcttaccatttcctttttttccataaaggtcctgcacgatgataaccgcataatagacgagataggcaactgtcaggacaatggtgaaaataaaatatgatttcatatctttttatgtaatatgatttattatatttgattgtggctgcaaaataagaatggataagtttaaagataaaattattggctacaaaacatattattttaatatgatattttctcaaaatacaaaaatcatattacaaaatcatattcaaatacgattttacataagaaagcaggaaaagttggggtataaaaaaagccctccgtgaaggagagcttagggagtgggttgttcattgtttcttcccgcgtaggtagtcgtttaggtctttgtaaccggcataacggttggactcgttatagacgcgtccatcatacatcccggctatggtttccactgtcttttgtccggcaaggtcattgtcaaggtaacagtggatatacgtgtatttttgcagatacgtcaatgtctttttcagattactgatcgagttcataataaggtggtcacagggagcattaatacaaatggcactatcgtccgtctgtttgagagtcagataggacagaaagtccatgaacccttcaaacaggcagacacggctctgtgtctcaccacgcgattggagtatcaaagaaatgtccttgttcttgatacatcctttataataagggtttcgcacctcgtatccaccggagatgttgccaaaagccagtgcaaagtaacgtcgctggcgcagttcgtaatgcacttccttacagaacattcgtccgatatccgaatcaatcatacgtgaatggagatatgagaacagtgcgtggtgtcgcagcggcacgataatcagatttttcatgtcggcttccacgggtcggaacgttgtgggcaatgtccgggttttcggtagcgatacaccattgacatgccgttcgatgtatgctaatgcttcactcacactttttgtttcgcaaaggtacttacccagttccacaaggtcgcctccggtggcctcgccaaaatcataccattcattcagccggtcattgactttgaacgatggcgtcacctctttcctgagaggcgaaagataccagtattgctctgatttcatatactgcgcacggtggccgagctgggccaaaaagtccacgatacgcactcgttttgcttcatctatggtcatattcaaattcttttcacttgtttgcgcaaaagcggtttagtttagtttgcgaccctatatatataaatactaaattaaactgaattatataggcccgcgcccgctctcattcttcatcgaaaagcatggtttctgcctgtgtcatgtcataataaaaaagtttatctcgtttgataaccagttttaaggtgtcagtcagatattgcagcagtttgaccattacgtttctcccacgcttaaatccgattgcctcgtaagctgtcatcatggcttgcagcatattttcaaacccacggataggtttgtctccaaacgcagcggaaagggcttcacggtgctgttcgacgcttagttccataaaacccgtccgctgtttcggtttctgatgtggggcattctcaaacaaatgcccttctgcgagaaccgggagcccgccctcattaacagtgaaagcaaagggtttaaactctttctcacggatgtgtaacgcatgaacctcgctgacgttgggacaatcgttgtttttgctgatgaccagtacagtctccgccttgttgctcatttccgtaccgatatgcccgcgcacattgttatctcctttattcaagtgtagcacacagtggatatgcaggtcatactttgatgaccactccatcatcttgttaatgacttccacggactcaccggtgctgtttatgtcaagcatcaggtcacggataccgtcgatgataacaagtccgtatccttttctttgacgtaaggcgtagtcgatgaccccaatgcgtattgccggagagtattcgcgcaagcaaataaagtcgaggttttcactgtcggttgtagtgggcagtccggcaagccgcaagatgcgttccagtacattatgacaatgaaagcggctctgttccgtgtccacgtacagaatcttacgtttaccttccgggaggtgcgcccggtagttcagcacttgttttcctgccagcgatgcagcgacaatggccgaaacgttaaatgttttttttgatttcgccttgccggttgatgcgctgaagttgccgagcgtagcaatggtcgagttgtctatccagataatctgtggcggcgtttcataggtgtccgtcgcccgaatctgcgaggcggagaggatatccgataagaaatcctcctccggcctcatatccacattatagtcagttcttctttcgttttccatggcgtctttgattaaagaaaggttgtgtggcagcggcctcgtttgccatacgtgctgcttcatctacggttggttcataattctgcaaaagccattcatccagatcttctttggcgaaatatatcattttgccacgtggcttgtaatgcggaatctccttgcctgatgttagcttgtacagcatactctcggatattccgatatacatacaagcctcttggaaggtaaacacctgtttggtggtatatatatttttttccagcaatgcgatgcgttccaacagactctctatcggatctaatttctttaggatggcttcgacgcttgtaagccgttcactcagccgttccatgaatgtcaatctattattttgcataaatgagttattataaaattagacaatggaagtatgccctccgttatgtagcgcgctaacggagggcaaagatagggcaacccaaaaggtcagcatgagtttgcaccgtgatagtaaccacgtatcacggcaactatcacgcttttacctttcacatacttcgcttattggcacttcttaccactctctcagttcatcaatggctcgcctgataccgtaacctgctgatgtcatgttgttgcgtagagcagacagagcggatgaaaggcttgaagctgaaacgaatccttttccgtccttggtttgtaagaaccgtccattactgagaacggtctgccatttggcttggatgaacgagtgttcaaggagtgtatcgaacaggatggccacatgacggatattgtttacacgaatacagaatccttccttgcaggaaagcagggcttccatatcttccacgtgtagggtagaaacgcaaaacagatgataagcattggcacaagccgtaatacctatcatctgtttacgagtgagattgcatccaaaagaaagaggataaatccttgtcgggccgtctttgcagcacgtgatggactgtgatggtggcacaaacatatcatacattcgtttcagttccatacacttctcgaacgagaagtctgcttcggtaaaaagtgatcggataagattggaacaatcgtttaataatcctttgacgatatgaatgttcatttcatggcagttccggcagaccgcatgattgcagtcgatataccggtggctgtttacaaaatcctccacgtaacggtggtactgcttactacccgccacgacatcacggagatacattgtttttgcttcaacgagcaatgcgaaaaattctttcgctacatcctgttcttcaacaaaatggtgcagatgtttcttccctccaaaaagagagagggccattgttaggtcttttcatgatgaaatactttaaattggatttataatatattataagggtgttgctcccgaaagaaaatcctgccggaacaacaccctaaataagtgtttagatatctggtctgatgctcatcgcattgtcaatcgaataaaccgttagtcagatttactgcatcgtcttttttcttattgacgattttggcatacacttgggtcatctttacagatgtatgaccgagcaatttagatacagtgtataaatctgctcccaatgtcagcatcattgtggcgaacgtgtggcgggccgtgtgaaaggtgaatcgcttggaaattccggcggctttggcccatggtttgataagctggttgatacctgaaggcaaatcgaacacatggtcgtctgctgtcttgtccccacgttccggcatccacttcaacgcttcattggagagcggaaggtaaatcggctcctttgtcttctgcatggctactgccaagcggtattggccgttgtcaataaacacgtccttccattgcaatccgataatatcactgatacgtagtccacagaagcaggagaacaggtaggcactttttaccccctcgttctgcattggtgtagcgattaataatctcacttcttcaatagtcatataagaacgcacactttccggcatcttgggcttctccgatttttccatttcgttgaatggattctttaagatgcgtttcgcgcggacagcggcatttaacgcaccgttgaatatctggtaataggtattacgcgtagaagccgagaggggctttcctttgggacggtagcttgtcaacatatagtcgatatagccgtggcaaaaagtgaggtcaatctgatttaatgtgaacctttctcctgcatactctttcaagatatcggtaacagattttatctgacctgtgtttttcttgccacgtttcttctgttcctccttatagagctgcatccagtccagcagataaaccttatccttgtgattcatgataccggcttcaccacttgtcaactctatgatacgcttcgatttgattgcatttgcggcagccattgtcgtttcattctgttggcgggcattacgatccgtttccggaataagatacattttcagatactcgtatgtccgcttaccattacggtatatatccagatacaaactcttgctgccattggccaattccttcgttcgaagacgaatcggctctttcacttttattggttttctggtccttggcatatttgtgtcctttcatttgttatttcctatcacaaaggtacaaataaaaagcggaatcaagaaacaaataagaaacaaaaatgcacctaaaaagagcaaaacaactgaaaacgtagaaaacaactgaaaataaaaaattgtatgtaaattattgatatatagctattttatctatatttatttggagcttgttttcattttatatatgtctttatgattattggaaataattatggtggaatgctggttatccgcaaacaaggaattatcaaatcaccttcccgttccccgtcctttcaagccattcgagggcctccctgttcagactgttcctgcatgattgatgcagtactccccgatttgtctgtgagcaagcatgttgtactctatggatttgtcaatcttcgaacggctatgatgttgtggacttttctttctcctttgttgtcgaatttcttgttgtcgcttgggtggttgaccacttgaccattcacccataaggtggtagaaccgcctccatccagattaagtgcgcaatgtgccttcagaattcgcaaaagataggcaagttctgcaatggacattccatctgcgtgcccttctgcccttccatctaccgctaccagcattatgtcaccttcttttgtgagtgcaatggcacttctgggatgtctggtctctgagaattcccgatctatcgtcgtgaagtcacacgtcttgccgtcctgcatcaagagcggtccggacgcaagtatatccccatccagcgggaaccctttcttctcattttcgtcgttccatggtatgatccggatattgttatccaccatgtgtacggcaccattgacacgcaaatgcctttcttcggtagttgtcgtatctattaccgcttcatttttacggaggtaacaggtagagaagccttccttgatactgaagtacgacccgtttatggctgcagaagaacggctttgttcagccaattggctagtggtggtcagcgagtccgtcgtagcaataaaggctgtatagccttccgctcttccaatggtcaggatgctgatggattgcttgcctccaaacaggccttctatcgaagcttgtttcaactggatgccttgcagtgaagatgttctctcccatttggccgatacgatggccagggaatccgatggattgctggctttggaaagctgtacgcccgtgagtgtgagcactgaagcaaagatgaaactgagatatttattcatggttttcagatgatttgatgacaatgaacgaggttactctgcgttgtcccgcatggtcgaatttcttgttgtcagtcggatggttcacgacccctcctactcgctgctctgaagaggcaatccacatggtagtggaccctccaccatccaggttcaaggctgattgggggcagaagtaagtaagtagaaatcgggtcagttcgtttgcagacattcctgccgcctgggtacttcttccgtcaacggttatcaaaagcagtttcttatgctctgtaagtgctaccgctgtccgcgggtgtctcactccctggtgccttctgaagtcttcgtaatcaagcttgttcaggtccattccttctacgtttccggtaaaattcagccctacaggatcgttgttgtctatcaacatgggagcaccggataaaatgtttgctgcggggtgtgaaagaaaagtcgagtcgctggcaaatcggatgtcgatgttcttgttgtcgtcatcgaacaggaaggcaccttcgtgtttccagtatcgaatgtgtgtgctgtccaaacggttttgggcaaggagtctacctccgattttgatgaacgatgcttcggcctcgtaggttccgttgatggcggcagccgcattgttgcgttccgctacagaagatagggaatccccatgctcttcgtaaacaagctgtatatcataacttggggaggtcaggtcgacctcgagaacgtctacattttggtgcgcttggctgatggagtcatatccggcgaatcggtaatgtatcagtgccggcgcaatggtgtctgccacccacccgtccgaaatacgcagtaccgggtttgaagctgatcccttgttggatattgtcatgcaagacaagcacagtagggaaataaaggcggttttcagttttttcatgagaatccattaaaagttgggcgttggggtattcccaacgcccgatagtgactatttccgttgcccttcacattccaatcgaaacagaggttggcaggctgtcccaacagaaaccaacagtatcccgaccgagcagggcaacgatgaataacagggattggtttatcagttatattcgttgaggttgggattgtattgcacctctgattccggcaagggaagataaaggtttgtctttccgttcatggacactacctcttcggaaatcttgttggtacgaatcaggtcaaaaaacaggaagccctcacagtaaagttcctttctgcgttccagggctactttcttctggtagtcttcctccgaagcaatatccgagttgttgtacggattcaatcctcttgaacggcgcagctcgttcagtctattcagtccgttccgtccttgtgcttccgcactaatcaggtacatttctgcaatacgtgaaacgatgagcggcgtaaaatctctgaacttgttcatgatgatataggtttcggaaacgctctccagcgtagtgatgcaggtgttgttgcgcgtatcagccggatcctcgaacagtttctccgattcgggagacgggcagagaaaccagcttcctttcatcggtgagttgtaggtggtgaacagggcgtacaagttctggcctccttcgctagtgttgttgcggaaactgaagattatctcgctgttgttggttgtcgtgaagatgttgtcgtagttttcgctgagtttgaatttgggatttgcgatcagcgtttcagccatatttttggccgtttccatatctccggttgtcagggccaagcgtgccatcagagcttgggctgcttcgaggcttaccgtgaagggtgcgcccgaagtttcaccaaaaggtttcaaatgtccttcatcgatacaaaaacttaactcttccttgatgaagttgaacacagcggactgtttgtcacgctttacgttctccagggtattgtccttgatgatgggaacaccatcccagcgtgtggccagacagtaataggcgtatgcccggaggaaacgagcctgtgcctctatatgggtgttcttttcactgggctccaaattggaaaggatggaaagggtggtattggcattgtaaatggccttgtagtaaccacgccacatcgtaagcagcgtaccgttattggagggtatctcgttgtttacaaagtcattggaaccgctcaggtaggtattgatcagattctcgccccgcatgtcaaagagtacccaggtgtcgcgacccgggtcgttctgtaacgagcggtaggtaccggttagcagttgttccacttcaccttgtccgagaatggagggtgagacggccgttgcaggttccagatccaaccaggagcaggaactggtacccaacgcggtgcccagcattaatgtatatatcagatgatttagtttcatgatgaatatcgattataaatgaattatatttagaaagtaagattgaagccgcagacaaacgtacgcaactgaggaacggtcatggcatcctcgcccattgtcttggaattgttgactgagtagctgacttcagggtcatatccaggataagagctgatggtccacagattctgtgcggacaggtacacacgcatattgctgatgttcagcttctgggtcaggtttgacggaagggtataccccagtgtcacatccttgaatttgaagtatgagccatcatgaagcaggtaggtagatgcctgtgtgttgtgcgtgctgatcatggcacgaggtatcgagttgtttgtgccggggccggtccatcggttggcagcaatgtccttacgcatgccgtagttgttgtgtccaacggcatcaataccacccataccggtagcatagacatcgttgccaacggagaaagtgttgaagatggtcaggtcgaaattgccgtatctgaaccggttggtgagaccaccgaagaaatccggaaggggctttccgacgatttccttgtcggcgggtgtcaaatcaccatcattgtccttgtctgcatacttgatgtcaccggcacgaacccccttggcataaagtttttcaggaacctcttgattatcttgatagataccatccattttatacatgtagaaggatccgatgggttgtcccacctgaaggacatggttgcctacaggaatgggcttttcatcaatcagtgaggtcagcttgttcttgatcgttgagatgttgaactgtgtatcccagctgaaccggtcgttcatgatgttgtgactctctacattgaattcgaaaccggtgtttcgcatgctgccgatgttttgggtaatggatgagaatccagttgtagtatgcagcgggcggtcataaagcaagtctttcgtgttcttgatgaaatagtccataccgacagtgactctgtcattgaacagcgacaggtccagaccgatgtttgtctggtcggacttttcccatttcaagtccggattggccagggtggtgatagcaatgccgtcctggccgttgtagttgtgtccgccatttgccagtgaacgggagtcatagtttccaattccttcctggttaccggtcataccccagctggcacgcagcttcaggtccgagatgattccgtcttttggaaaaaaggattcgttgctgatgcgccaagcacctgacaccgatgggaaggtaccccattggttaccgtcagcgaacttggatgaaccgtctgcacggatagagaaggtgaaaaggtatctgtccgcataacccatgttcaatcggaagaaggtagagatgagtcgattctttcctccggtggtagaagcgctgttgattctacctgccgcgttgatgtagtcaaattgtgaagacgggaagtccttgccgacaatagaactggcatctgtgttgatttcttgcatggagtaccctcccaatgccgtgaaattgaagtccttgatctgtttggtataagtcaatgtattatcgatcagataattctgcatcatcgaacgatagtctgtaatctcacctttcggactgccgtagggatggtccttagtcagcttcagatagtcgtttgaatagcggatgtctccgctcaggctgagcttgtattccagtccttccaacagtttgatggtcaggtaggcgttggccagcactctgtaccattcgtttttggacttttgttcatttaggacctggatcccgttgtgtcgtggaatatccacgcctccaatcatgtatcttccatcttctttgaacggcacatcaaacggccgctgctcgatggagcgtgtaaagatgccgttgccgacgttgtcattgggaacgcggttgttaatggttttgctgagtgcaatggacaccccagtctggaaggcgttggagatgtcgtggtcgacattggtgcggagtgaatatctccggaatcggttcgtaaggataataccttcctggtcgaagtatcccaaagaagagtagaaacgcgtcttttcgctaccgctggaaaccgaaacctcgtagttttgtacggctgcttggtcgtgagtaatgagatcgatccagtctgtatcgggttgtcccggacgggggttgacttccagagtcttgtagaggttgtctcccggtttcaggttgttttgggtattgtagttgttgacggcttcgttacgaacagtaaggtaaagatccgagtcagccatttcgatttccttgggaagtgactgcaaaccgtatgaagcactaagatttacggttgtccgttggcctttctttcctctcttggtggtgaccatcacaacaccgttggtagctctcgaaccatagatggccgttgccgctgcatccttcagtacgtctattgactcgatgtcgttgggattgagcatggacagcggattctgcacgctaccaccaaagcgtccgttgacgcctgaattgtccgagttgcttacaggtataccgtcaatgacgaacaatggttcgtttgagccgttgatagaccctacaccacggatgctgacacggacagctccaccgggcatacctgatgcgttcgtaatgtttacaccgctcaggttaccttgcatcatctggtccaagctggttgttaccgaaagctttttgtcgctggccttgagtgaggaggttgaaccggtcagttctttctttttctggacggcgtatccgacaacgaccaactcatccagcgcaactgcatcttcttcgagcacaattttctcgaccagctggtctcctttcagttcctgtgtcttgtatccaacgtaggagatgacaatgacagcatcccgattggatagcgagagctggtattggccgttgaaatctgtgatacatccgttgtctgtacctttctcaaagatggttactccaatcagtgggtttccatccttgtcaacaatggtaccgttgacattcttctttgtcacaacatactctttggtcaacatcttgctgtaagtctgtgatgcaagagcaggatgagacatccctaagtgacagcatgtaatacagatagacgatgcaatctgtaagtaacgtaatttcatataacaatatttaataactaaaaatcctttgttgacaagtagtcaataactcttaaaaacggtcgcaaagtaaggcatatccgtattacagggaaagcgaaactggttaagttccaaattcgaaagcgttaagaaaatgttacataaaaaaaccggtaagtcaaagatgaccgctcgtatatattaaggtatcgttgccaagtatgaggagttcggggagaggttccgggtaggtggattgtaatcgattaatgtaaaaaaacgtactttattttgtcattgaaacgtttctgccacttaactgctatgtaatatgatgccggtatttttgccaccatatcaataacaggcatatatcatcaaatacatgaatcatagagcaaaagtcctttccggcatgggtagtgtgccacttttatccgtcgctgcgccaatgtctttttggagaggatgtggattgatggagcattcagtaatcagccaaatggaactttgtcggtatgcggataatcctgctttattgcctctaaaccctgcttggaaatagtaaattcatcatttaaattaatagattatatggaagtaaagaaagtattggtgagtgcattccttttgaccacttgcttgatgagtggacaggcgcaacgccggaatgaaattcaggttcctgatttggacggatataccacgttgaagtgtgactttcacatgcactctgtgttctccgatggtctggtttggcctaccgtgcgtgtagatgaagcctaccgggatggactggatgccatttcactgacagaacatattgagtaccgccctcacaaacaggatgttgtttcggatcataaccgttcgttcgacctttgtcgggaacaagctgagaagttggggatacttttgattaagggcagtgagattacgcgagccatggcacccggacactttaatgccatcttcttgtctgattccaatccattggaacaaaaagactacaaggatgcttttcgtgaagccaaaaagcagggcgcttttatgttttggaaccatcccggatgggatagtcaacaaccggatacgaccaagtggtggccagaacatacagcactctatcaagaaggctgtatgcacggtatcgaagtggcaaacggtcatttgtatatgcctgaagccattcagtggtgtttggataaaaaccttacgatgatcggtacttccgatattcatcagccgattcagactgattacgactttgagaaaggagaacaccgtaccatgacgtttgtctttgcgaaggaacgctctttgcaaggtatccgcgaagctttagacaatcgccgtactgctgcttattttcatgagttgctgataggacgagaagacttgcttcgtcccttttttgaaaagtgcgtgaagattgaagaggtaagtcgtaatgagcaaggagtgacgctctctatcaccaatgtgacggatcttgttttgaaactgaaaaagacagcgcatgacactttattggtgtatttccgggatatgaccttaaagccacatacgcgttacactgtccgtatcgggtttaaacagggtatcaaaggtggcgatgtaaatttcgaggtaacgaactttattgtggctcccgataaaggactgaaatataccatttctctgtgagatgctatcgatagtaattcatggactgatcttttgcctgcacgctgttcctactcttttgaagagttagaataagcaataacggtggcatgaatagccaaatagattgtgatggccatgagtcaatttattgaatttgaggattcatcagacttgttctttatattttatctacattcaatcaaattgatatcaaaagtttgaatatctaatttaaattataggtttatatagatataaatcaacaagaaggtgtgtcgtaatgcacgatgcacctcttttttgttcatcactatacaaatctgttcattttctttaagctgcgatcttttgaagatttctttgatttatgcagcgggtggagagaataagacttttatcggttcggcggactggatgccgcgcaacttggataacagggtggaagtaatcactcccgtttatgattctcgaatcaaggaggatttatggaaagtcattgattttggactccggggtaattgtcagggtagcgttgtcgacggaagcggtaagaactgcctttggacaacggataccgaagaatcttttcgctcgcaagaagaactatataagtattacaaatcacatataacgaatgactgatagtaaatgttacgcagctattgacatcggctctaacgcagtgcggttgttaatcaaaaaggtgaagaataatgagaatctagccaataagcgcctttccaaagtgatgctcctgcgtgtacctctacgtttaggctttgatgttttttccttgggagaagtgtcggatgcaaaggtgatgaaattgcgcaggttgatgaaggctttccgacaattgatgaaaatttatgaagtgacaaactatagggcttgtgccacttctgccatgcgtgatgcccaaaatggcaagtctgtaatcaaaaaggtatggaaagatacgggaatcaacattgaagtgattaacggtcaagaggaagcacgtatgatttataacaatcatatcgagtgtttggaagaccgtgccggaaactatatatatgtagacgtcggtgggggaagtacggaaataaattttctcatcaacggagagttggtacagtctctatcatataatataggtaccgtccgaatgttgagcaattctgtaagagaaggtagttgggaacagatgaaaagtgacttgactcgtttaactgctgattttcaaggtgtcaatattataggttcgggtggaaatattaataaactttatcgtcttgctgataaaaaggataagaaacaatcacgtttgccaatcacttctttgcaggagctgtatgataagttaaaagttctaactcttgaacagcgcatggaagaatttaatctgaaaactgaccgtgcagatgttattgttcccgccgctgggatatttctgataattgcaggtattgtcaaagctgagtatatccatgttccggtcattggcttagcagatggtattattgacaatttgtatgccatagacctgaaaacggaataaaaggaattgtgcatagctgttttaactagggatattcagtaaatcctataaaattagccaactaattcatactaaaagtattgcgaattagttggcttttttgtatctttaggtatttcccctaaaattttgaagaacgattgacaaatgcttcagcggagtcgttcaatgctaaaatcaaagctcttcgaagccagttaagaggggtggctgatctgaaattcttcatgttcagactggctaggctatacgcttaaaggaaagcttgccaaccggaaaaatccgctgcccctggaaaaagcagcatagccaaaagaaaatataacagaactgtaaaatataaaagaggttgtgccaacgttttgacacaaccttagcagattactattcagctgatacctattctgaaagatgtaaacaacttgtttcttagatagccttataaatattctactacttattacagttcatttagaaatgttattctcacttttattcctccgctttttcacttgctccactgcttcagatatgattcccttgttttcaaaacgctgcgtgtaattggtgtaatccgggtgaatacgttcgtaagttgggtcagtgaataagggactcgtaataatgtggtccgcagtcgaacggttacagcagaaaacaatattttcaactccagccagtctggtcaatgctttcacatccgtatcatgcggctgtagtgtcatcggatctgtaaaaaagaacagatagtctatttctccttctacgatccgcgaaccaatttgctggtcacctcctaaaggaccagatttcaggattgtgatatcccatttgatttcaggatgtttttcttcaagggcttttttaattagtgtaccggttgtacccgtacaatagaatttatgtcctatcagacgttccgagttccagagaacccactctatcatgtcttttttcattgcatcgtgtgcaacaagtccaattctacgaacaattgtttccataaagctaaattattttatttttatatgataattataataacaaaaaaactaattctattgaaggccggaggatgaccggataaatctgagcaattctttgtttgcctggctatccatgacggtttcccgtttttcttcaaaaagattgagtgttgtggagcattccccacagatgtcaatgcccactacctgttctttctgaagaataacagccagcagtttctccaattcccataagctgagagaaccttgatcccagtttgttgctgccgaagccggcttcaagacatccttgtctatggaaatgtaaaccggtccgttgatatgtccggaagaaaagttctgccaaccctcttcgtgcatgagcgtagtttcactgtaaaaccgaacttgtctttcatatcctttcggcacagcctgtatcagtttgtctgaagcacctacgataattactttcttgcagttgttgttatggtccaatatatcctttacccaacttccgcaagaaagtatgttgtcaaacaacggtggctgcatatcgggatggtggtcgaacacaatcagcgaaaacggagtttcaagtttgtctgtccagaatttagtcaaataatgataattgcctgaatcgatgaaatggactccctccgccggataatcagcaatcatccccttcaaagccaaagccccctccctatcacagtagccatctgtaccataaagatgacgacaatccagccatataaatttattgttccgggcaaacgcctcgtagtcatacactcccgtgaagttcatgatgatgatcggccatgctatccgtttatctgttttttgattttgcccgctcatacgttgtttttgcatatccttttactgttcattaaaaccatcgtacataacagaaatcttgtcggtgaggtaacaaagcattcttgggatacatacggaaggcctgcttgaagcttccagcgttgaaaataccggatgtcgccttaaaggtatataaattcccattcttggaaaccggcaaaaggggaataacctcatatatgtgatcctgaccgtcttcacgcctgataatgaccgattctattccgattgcgtcatccaggcctttctcatcaacgacaaccgtcacctcatattcctttccggcttcaaccgtggcattcagcccattcccagcctctatggatttgatttctatggcatcccatctgcttcggacgtttgctttccagtcagccatcattttcgccttcgcaaagttgtcggctgccagaatgtggaaatgctctgacagcttgttatagaacctgtcatagtagtcgtccaactgtcttttcatggtaaaatggggagcgatttgtgcgattgagttcttgatatacttgacccagtcttccgaatagttcttccccccatactcgtaatacagtggcaggatgtcatgctccaacaaataatagatggcttcggcatccagctggttttggtactgttcattctgataagtccttttatcagtcagtgcccatccagcatccttacggtatccttcataccaccaaccgtccagcacggagaaattaagcacaccgttcatcaatgccttctcgcccgacgtacccgaagcttctgccaaccgcgtaggggtgttcatccagatatccacccccgagataagatggcgtgccaggtccatgtcgtaattctccaagaatatgattttacctaaaaattccggacgccgggatatttccacgatttgcttgatcagcccctgcccggcaccgtcattgggatgggcttttcctgcaaagatgaactgtaccggatatttcggattattcacaatcctggcaagtcggtctatatccgtgaacagaagatgagccctcttatatgtagcaaaacggcgtccgaagcctattagaagagcatcgggattgaatctctcaaaaatggaaacgctcaatgccggatcaacctgactcctgagccagtccttgctgcatttgcttttgatatagtccagcaattttgctttctgttttaaccgggtattccatatctcttcatctgggatgccatagacggcctcccagattttctgattggactggtcgcagaaaaaattctcatcaaaattgtccttgaaaagctttttccattctgccgcacaccaggtaggcagatgtaccccgttggttacataacccacatggttctcttccgggaagtatcccttccagatcggcgcaaacatttgctgggataccgatttatgcaacttgctgacaccgtttacctcctggcaggtcttgcaggcgaagacagacatgcagaaacgttcctccttgtctcccggattgtgacgcccgagatccatcaggttatcccaggttatacccaacttgccaggatatcccttcatatatttattgaaaagcccttcgtcaaaataatcatgaccagcgggtacgggagtatgtacggtataaagtgaggaagcacgtaccagctccatggcctgcccgaaattcaagccgccatttatgtaatcacaaagccgctggatattgatcagtgcggcatgcccctcattacagtgatatacatctttcgttatacctaaagctctcagcgttatcatcccgcctatgccaagcagtatttcctgttttagccgattctcccagtcgcctccatacagatggtgagtgatagggcggtcaaactcgctgttgagttcattgtccgtatccagcagataaaggggaatacgccccacactggctttccagacattggcatgtaccacaaaactgtcggcataggggacgtggattaccagttgtttcccatccggttgcattaccttttcaatcgggagctgcccgaaattctgcgctttataattgactgtctgctggccgtccatggaaagcgactggtcaaaataaccgtaacggtacaaaagtcctatggcacaaaggtccacattgctgtccgacgcctctttcaggtaatcccccgccaacatacccaaaccgccggaatatatcttaaggacttcatccaagccgtattccatgctgaaataagctattgacgggcgctggtgatccggttccacatcgacgtattttttgaaggcggaatagacggcatccattttatagacaaagttctcatcatgtgccagcgctacaagcttctcataatttatccgctccagaaacaataccggattctgttccacctctttccaaagttccgaatccaaatcacaatacagtttctttgcgtcatcattccatgtccaccagagattatgtgcgatttctgcaagtttccgcagttctgcaggaagatgtgaacctactgtaatctccctccactgaggggtatttacattataacttgaatattccatgacattttaattaaataagtcctaatctttattcagtccttttattatttttcgtttaccgacaatccataccgtatcattctccttgaaaattgtatcagggtctggattcataatattcacggtactcctctctattccgataatgatgctatccgatatgtctgcctcccggatcgtctttccgatcaatggtgaacctccttcgacaggaaattgccctatttccatctcatcctgcgaggatgttccgttcccgttcctttctaccttcttttgctccatggatgtccggaagctttccaactgccggtccgtacctacgaccgtaaccttgtcatatggatagagatgttcttccccttgtggtatatccaggcgtttttctccacgggtgattgaaatcacatttatctgaaacaaggtgcgcaagctgctttcttttaatgttctgcccacatatatggaatcaggggatactgtgaaatccgccaaatgtaattccttgaacgggatattgctgccaagggtggagcctgtatcactttctgtagaaagtacattcccgtccgtcccctgaaagtttgccataaattgtctctctatagtcagcgaccgtttcttgatccgcttggaaaaataaatgacggcaatgataatggaagagactaccaacccggctcccaaggcaacattgaaaagatgggtaatgatactcatcatgataatcgtgcagatcagtattttgacaagtactattgataccaaaggccctctgttgaacttgttgtccgtccagagtttacggaactcggttgaattgttccttttcatgatgatggcccatagaaacggggatatgacaagaaagatgatgatgaagcccaacaagttcccttccattcccggcagacttttcctaatcaaaggatgcacataggaaaaatataaagtgatgaaaaaaacgcatacgaccagatagagtgtgacagacaccagcatagaccggatcagtttatgccaagtcccctggtgttttacagtcattgccccggacgtatagtgtacgagataatctttcagggattcaggcatgtggatgtctataaaccggtatgctggttccgaaagccgtatcatatagggggtaagaaaagtcgttatgacagatactgccactatgaccggatagagatacttgtccgtaacattcagactgacgcctaaagatgcgatgatgaatgcgaattcaccgacctgtgtcagtgaaaagccggactgtatggcaattttcaacggctggccggaaagcaagacaccaaagctcccgaacaggacctgaccggacagtaccagcaatgtcaggatgagaatagggacggcatattcccacatcatggcaggatcgatcatcattcctaccgacacgaaaaatatggaagcgaacaggtcttttaccggctgtacgatatgtacgattttttccgcttcaacggtctctgccagcagggaccccatgacaaaggctcccaatgcggcagaaaatcccgcttttgtcgcaatcatcaccattcccaggcaaagtcccagagaggttatcaataaaatctcgttgctggtgaaacggcgtatcttcttcagcagggtaggtatcagatagatacccaatgtcgaccagaaaataaggaaagcggccagcttcaatatactttccagcatctccttcccttcaaaatgtttgcctaccgccaacgtggaaagaacaaccatcatcactacagccaccagatcttcgataacaagaatccccaagacaatgccagtgaatttctgttggagaagtcccatatcattgaaagccttgaatacgatggccgtggacgacatggacaacattccacccagaaaaatactgctcatgtgggagaaccccattgcattccccgctgtataacctatgaacatcatgccacatacaatagtgacagtggcaacgatagccgtaatgcccacatttatcaatttcttgaacgaaaagtccagtcccatcgcgaacagcagaaaaatgacaccgatgtccgcccatattttgatattggcaggatcggaaacagtcgggaccagggaaacggaaggacccgccataataccggctacaatgtagcccaatatgaccggttgcttcagccacttgaaaatgacggttacaataccggcaataatcagaattatggcaagatccgatattaagggagcaacttctgacatgttgacggctattttatatcgataattcgttaaggacccggatcaggcttttgtcaatagtcttgtcctttttgattgcctggacaaaaggaacataaacaatctcgttgttccgtatgcctatcataacattccgctggtcttccattaaggcctggattgcggcttcacccagccggcttgccagtatacggtcattggcactcggagtaccaccccgttgcagatggcccaagatagaaaccctgacatcatacccgggatattccttctttacccggtcggcgtaatatatggcacctccattcttgttttcaggactttcggtcacaattacgatgctgctgtttttcgtctttctgaatccgcgcccgatgaatgtttccaactggtccacgtccgtcctgtcctccgggatgatggccgcttcagcaccggaagctattgcgctgttttgtgccaggaagcccgcatcacgccccattacttcgacaaagaagatacggtcatgggaggttgccgtgtccctgattttatccacgcattccacaatggtgttcaatgccgtatcatatcctatggtaaaatcggtaccatataggtcattgtcaatggtgccgggcaatcctatgcacgtcacatcatactcctccgcaaagatacgggctcccgtcagggaaccgtctccaccgataattatcaaagcattgatgttctctttctgtatgaccttataagctttcttgcgtccttcgggagtggtgaaagtctcggagcgagctgttttcagtatggtgcctcccctctggataatgctacttacatcttccgtcgtgagttctttcacttcaccggcaatcagcccctcgtaacctctataaattcctttcactttaaatccgttaaaaatggcggcgcgggtcacggcacggatagccgcgttcattcctgaagcatcccctccggaagtcagaattccaatatacttgttatccataatttgttttttatattttaattaatcaggcaaaatcagaaagcaactgttttagcctttttctgctataaaagatacggctttttatcgtacccagtgacactcttatctttgcggctatttcccgatatttgactccggtacaacataaaaacgacataatgtgctttaggcaatgttttaagggcttcccttatctcttttgcatcatgcccattatccacgaaaatgaaagagtcgtcccttaacaggaaatgatatttaggttctgataatacatataaattccctcgtattttctttgtccggcaattattgataaatgcattgcgcatgatggtatacatccagcctttaaaattcgtaccggaatcaaacttatccttattatccaacgtcctcaacattgtttcctgcaacaagtcttctgcttcatccttgtcagcagtcagtttatatgcaaaacaatgcagttcattctgaagggctaccagcgctttatcgaaatcaaatcctctcattatatttattttggaattcaaatatccgggtgaaggcattccctgataataagaaatgccttctgtagagtctcatcaagatatcttatttgacatcaatagttttggtggtttcctgaaccttcttatctacgactttgggaatatcgataaacaggaccccgtgttccactttggccgaaattttatctttttccacattatccggcagcaggatactctgctggaatcgggaataggagaattcacggcgcaagtattttccgtctttcttctcctcctttttctcgtcctttttttccatgcagattaccagattgttgctttcatccacacttaccttaaaatcattcttggtcattcccggagctgccagttctaccttgtagtccttttcattctcaatcacattgatggctggagccgtagcgtttgctcttgccatccattcattgtcaaaggaatcgttaaaaatactcggtaaccaattctggtttgtttttacaggtaccatttttacctcctctttaaaagttaataattaaaacttaaaaaaaagcatctgcttgatagacagatttttattttttagccatcccttgtttggccacagcttctgcccgtttccgtatctcttccgggtttccaaggtagtagtccttgacaagaaccagcctgtcgtcaaattcaaagacataaggaactgccgtaggcaggttcaggttggaaatatccgtatcggaaattcctttgagatgcttgatgattccgcgcaggctgttaccatgggcgactaccagcaggctgtccttatacatcaatgcgggaaagatgatgcatttccagtaaggcatgacacgcccaatagtatctttcagggattccgtacggggaagttccctatctggtacaccggcatagcggatatccatgcccggattacggggatcatctttgcctaccggagcgggagccacgtcatagcttcttcgccagatgtgtacttgttcttcaccatattggaccgctgtttcactcttattcagtccctgaagcatgccgtaatgcttctcgttcagccgccaggtcttttcaaccggaatccagtcttcatccagccggtccaagacacagttcaacgtttttacggcacgtttcaagtaagaagtgtaagctgcctcaaaagaaaatccagcctcccgtaatgcatcgcctgccttgcaggcttcttcaactcctttctcgcttaaatccacgtccgtccatccagtaaaacggttttctttgttccataggctttcgccatgacgtaataacactattcttttcatggatacttcttctttatgcaatggttattgaagaatccagatatacgtcctgaatggtgttcagaagttgaactccgtctttcatcggtttctggaaagccttacgaccgctgatcagccccataccacctgcacgcttatttactactgccgttacgacagcatcatgcaggtcggattccccatgggattcaccgcccgagttaatcaatccgacacgtcccatatagccattcgccacctgataacggcaaaggtctatcggatggtcagtggtcagttccgaatacatacactcgtttgtctttccgaatccgatagccttgaaaccgccgttattggatgggagcttctgcttcacgatatcggctttaatggtaaccccgatatggttggcttgtcctgtcaagtcggcagcggcatgatagtcggtaccatcctttttgaagctgctgtttctcaaatagcaccacagaatagtagccattcccagttcgtgggcatattcaaaagcctgtgacacttccactatctggcggcggctttgttccgaaccgaaataaatggtagcaccgacagctacggctcccatgttccatgcctctttcaccgtaccgaacattacctggtcgtagctgttcggataagtcagcaactcattatggttcagcttgacgataaaaggtatcttgtgtgcatatttgcgtgccacggcgcccaacacaccgaatgtggatgccacggcattacaccctccttcaatggccagctttatgatgttttcgggatcgaaataaagcggattgggggcgaaagacgctcctgcagaatgttctatgccctggtctacaggcagaatggatacatagcccgtattggccagacgtccatgtccgtataaagcctgcaaactttccaatgtacggatattcctgtcggaattcatccataccttatctatcatatccggtcccggaatatggataagttgtttgtctatcgtcttacatgtatggttcaggtagtactcagcctctcctcccaataaatctactattttcattttatttatttttattgattattctggtttatgactcccgttcacccagttttgcatccataaaaaggatagcacagtctccggctttcctcagatgactaacaatattgagtacattcgcttcatcttctacttgctcacgaacaaattgccacaagaagtcctgagtggcattgtctttctcttcggatgctacctgtaccaactcatcaatcagtctggaaacatgtttttcatgctccaaagcatgctcgaatacttcaacagggttaccccaaccttgtggaaccacatcgaccttgtctactttcggggttgcctcacgcttaatcatgtacccggcaatggcatatgcatgcccggtctcttctgcagactgtttctgcatccagcgagccattccggaaaagccctctctttccagataaaaagacattgataaatacaggttggcagaccataattctgctgtgatttgctcattcagggcattttgcaatttttcagtcatgatgaatcaaacttttaatgttaataataaatccaaattatctctcttctttaagaacaagcatgggcttgtttcaagatttcaattaataccggacgtatcccgctgataaaacattccacggcgatcaccattagaataagtcccatcagtctcatcatcacattgtttcccgtctctcccaagatttttaaaagctgggtggacgcgtacagaataaagaaggaaagaatgcagaccaaagcgattacgccaagcaatactattttgaaagtatattccgaagcatcttccatcaatgttattccactggaaatcgctcccggaccgcataacatcggaatggcaagaggtgtgatggttatatctttggaatattcttttcgttcagtttcattcagtttcacatgggtaaaatgtgcctgcaacatatcatatccgattttaaagatgatgatacctcccacaatccggaatccgtttgttgagataccgaaaaaatgaaacagaaacctgcccgataatgtaaaaaggactaatatgataaatgcaatggtacatgctttcaaggcgatatatctgcgttctttcgtatccattccatcagtcatttgcaggaataccggcatcactccaagagggtccatcaaggtgaatagcgaagtgaaacacaatgttaaatatacaaatatatccatgatgacatatagtttattatcgattattatatcgcaaaaaacataccagatagcattctgcaatattaaattttgcataacatcaatcttaaatccataccgtcaaaaataaggtagtttccgttcgttttccttggcgaggatacgtaacaattccataaatgccatacttacatatatacggtctgcatacagcccgctgatgaaagaatggaaggacatgcttacattccagcataatatgagaaatgtgtttacctgacgtgatatgtactgctcatgttcaagcaattcattcaaggcattcaatggcgttgtccattaatgtgtatcccgtttcatttcattgattacaacacatcctccatcatggcatatccgattcatcatctgataaaccttgttcatattgtcctgtgcttgggagttcagccaggagctaagtattggaagccgttcatcttcaaaataaacctgcaatgacaggtataaaccggttgaccatatttctgtattgatcaactcattcatggcgttttctattcgtttatccattatcactctgaatattgaaaatccattactaatatcatgtgttattctcagtatataaaaattccattcgattgtgggtaacccataaaacggaattcttaaacgaggcttaaataataggataacttatcggcgtagacaaattgtcataaaaaatagcactatgatgtctttttgtcttgcctcccttgcagaatatccaataagacatccagttctctttctattccttcaatcttatcggaaatacagtccaaagtattatggtgcagactagctttacactcctgcaactctcttgacagagaaagtatctgtaaccaaagttcttcctctatgtgatagggggagttactattatctagtaccatagcaggagaaggcagaaaagtgctttggcatgtaatttgtatgataatgaacggtatgttccgaaagagacaggaatggaaatgaaaggatagaatattccacaaaagatagtaacaaacaaagggggaaagtcgttggagacagttgtctcgcttttaaaacaagttgctttcataatgtttattataagccaaccctgttccctggagttgtgtttatataaagttaagcgtgggaactttggtattaccgttcagaagtatccccatactcaacaacatataatacacaaagccccacgcctatatataacaaaaatctatatagatagaacgtggagcgtccaatgtattatccaattgttgtttcgaaattggggatttcctgaacttggataatgccttaacgctttactataaatcttctattttcaaaagactaatacaaatgtaataaaagaaatgaattctttgaaaggaaatatctcttttttttaaggggtagcttaatttttctttatttaaagtcttagaattactgcccaccaaaggttggaaaagccactcaactttgacccttttggccacgcaagatttgcccacctttttgtactatatgattgaccctttaaagtcctggtgttggggggcaatattattttacccttttaaaaattctcgtttttcttagattttaattttcgcatactttcaccatataattctatagtatgggccgtatgtatgatgcggtcaaggattgcatcggctattgttggatcacctaccatgtcataccagttggaagatggatactgcgatgtgatgatgacagatttccgttcatgcctatcctcaataatttcaagcagtatgggacgctctttggcgtcaagtggtacaataaacaagtcgtcaagaatgagtagctggcaacgctcaatcttcttgagttccgcttcaagtgtaccttttactttggcgactttcagcgcaccgagcagtttcggagcattggcatagaaggtacggaatccccttttgcatgcttcgtgtccaagggcacaggccaaatagctttttcccgttccggaagaaccagtaatgaaaaggttctgtgccttatgcacaaaatcaagggtggcgagacgttccatctgattgcggtccagtccccggttcgtggcatagtcaatctgctcaatataagccttgtagcggaatgccgcatttttggtgagccgtgcaatggcagcctgggagcgatagtcccattcgcgtgcaaggagcatggaaaggaacgtgtccgcagtcatggattgcggagtggtgccggcaagactttccctgaaagcctctgccataccatgcaatttcatacggttcattaaatccagtgatatggtattctggtcttgttgtcccgtaacgggagctgttttattgtttacttccataaataatagttttattgtttgtcttttttgtaatattcacgtccacgtatatttttgtgggtcaatggaatctgggaagtcacgttggactgtacttttccgtcctcatcaggaaggaaatccacatcttctcccagttcaagcacctcgcgcaaggcttggtatccgtattgcaatttctgatccgcacatgcgcaagccgcaactagacggtcacggccgtatttcttctccagtgtcatgatgccacggcatgacctgaacgctttgggtggatattgcatgacacgctccacttcctgaagatagttcaatacgatgttgtctatttccgaggcacgttgaaagagttcctccaagtccttgtcatagggaccataatgaccaggcaggttgtgctcctttttccaagaataagtgtaaggaatgtcacagcggtcatgggtggcgacaaggttcattccacaatagatttccaccgtgtcggcatcatagagaatcgtcatgcgcctgcctacatactctttcggaacactgtaatggtgcttgaacaaggaaacgtaagagttctttcccacggtcatcagtttcctttctttcattacgtagcgtttcacgggaagcggacgaagataatccttctctccatgaaggaatatttccttgcgtgacatctcccgtccggccatcaccttttcattgaaatcaagcaaggaaatatggatggcggtattgagttcctccaaactggaaaatgtcattccctctatatcaaggtaaatggaacggtagaggagctttacggcattttctaccaaagccttgtccttggggtgacgcacacgagcaggatagaccacacagccgtaatattcggcaaaagcggcgaaatcatcattgatgacaggttcgttgcggtcgcttcgtgtgacggcagccttcagattgtcggggacgatagccgcaggaacaccttcaaaatattgaatggcattctcgcatgcctttatcaggtcttccttgcgttgcgaccatacggcttcgcagtaggtataatggctgaacggaaggatggcaacaaatacctcggctttcttcgtctcgcccgtcatttcatcaacaacttcaagtctgtcaccggcaaagtcaatatacatctgctctgcggcatagtgctctacatgaccgacaaccttaatgtgaaacctgtattcgctgacaatccgtttgaaggaagacaactgatagccgtccggatattcggtatggtactccttgaacagttttcggacactcatacctttgcgtgacagacgagatacatatccgggaagcaaggcctccaattcaatccttttggatgaaggctcccgatgccgggtatccgtgcagccgaacagttcatccaactgtccattgggcagggaaagaagctgttcaatactcttgccgcttgaaaggaataagcggacatatttgcggactgtattacgggaaatatgaaacgtagatgccgtttccttgattcctatgccagccgcataacatcttaaaatgtttttgattcgtttattcatttgtatagattttattttctcccccgttacaccaggacaagggtactcaaatctacacaaaaaaactataattataggtgaagcaagtgggcaacactattttagccaaaggggtcaatcatattttagccaaaagggataattctgcgtggccaaaaggggcaaagttgagtggcttttccataagccatcaattttcgtttttttgttggggttctcttagtaagagaaccccaagtttacttaaatgcctgatagagtgtcctatagttataacctttcatattatttttgcaaacaattgtcatttataagcatactttggaatacttttttaatgcggaattttctgtattaaggaattatagctatctttgcagcaaaatggggttctcttactaagagaactccattttttattaaaggcttaaaaagggaaaaatcttattttcaacacattatattatttatacaatcagaatcaattttcctctcacaataattatggtgaactaaaaatgctcaaaaagaaagaggcttccgtttccggtcgcctctcttttcttttcggataaacgcttttatccgtaagtgtactgactttcacaagcaaatactaactattaatcttaaatctattactatgaaaaacacattatattaacatttgaatcgcgtagattgttcaacaaaatgagattaaaagagtgttaaatatatagcaaagggaggtccaattgttttttaatgcaagaaaaacgattaagtctgataaaagtaaaagaaacggaaatacaaaagatgtatcgtgatttcacataatcgtgacataagtaaaatacaatataaattatacaaaaacacactacaaaagagaaaggatgccaccaaggcaccctttctcatcgctcatttgtaactatagagagttagactctccttaaaaacgctgtaaaattaataaaataattttagacgcaaaattagttttgtagaaaaattcaaaaggttttcaaagtttatcagtattgatctgccataatgaactggtacgataatttatattggttttaaatgatattccttgtaaatgaattactaaccacggatatcttatattccattattcatatttcaatgaccgagcgggtttactataaacaacctttatggtttgtcctgctacagtcagaaaagaaatcaacaacatcaagaccacaggaagcagaaagaaccacactttcaattctgttcggaacggataatgagccaaccatgcattcatgctgccccatgccacaggcaacgcaatcagaatagcgataataataggaataaagaaacctttacccaactgataaaacagattccaacgagatgcccccaatactttccggatacccatctccttggtacggacggcacaagagaacataaccaacacccataaacctaagcaggagataaaaatagccaatccggtaaaacctcccatcaatacgccgaaagcctcatcctgacggtactgccggtcatagaactggtcgaggaagaaataatcaaaactagaatccgcaaagtaattattccatatttctcctatctgtgatactaattccgaaggatcacccggtttcatcacaaccgaaatataacgctgaggaatccagtcaatcttatctttatggaaaagcattacccctgtataacctttattcaacgcttgctgatgataatccttcactaccccgattacctgcatgggctctcctagcgtttcaacagctatttcctcaccaatggcatcatcattatccacatatcctaacatacgggcagccgtttcgttgataaccaatttattcacatcgtccccatattcctcggaaaaaccccgtccggctaccacctccagtccgtatgcatctatataatcagggtcacaactcagcatctcgtacaaccggttttgcttcaacgcatcatgtgcccgatgattggacaggaacatggccacctcttcacccggtaccgccccggaacaagttactttcgacgccaatggcaatttcttgatagctctccgcatagactccatctttgttttcataccctcagtaggtccgggaaacttgattaccagaatctggtcggtctttactcccaaagactgccgacgcatatagctgagttgtgcaaacacaattaatgtactacaaagcaatatcatggatgccgtatattgcactatgaccaatattttacgtgtattttctccggaacggctattttggaatttacctttcagtaaaacaatcggcttcttacgcaacaatgcgcgggcaggatagtaaccggaaatataaataccgactataaaaagcaatagaaccccgcccccccaatattccgtaaaccatacagagaaagtaatagtacgtcctaccaactgattgaaggaaggaagtaatagttcgatcaatcctaacgcaatgataaaagcgatcaaattcattacaaatgcttcaaatagaaactgaccaacaagctgtttcgggaaagctcccactaccctgcgcactcctacctctttggcacgctccatagaacgggcaactgtcagatttatataattgatccaagcgataatcaaaatagcaatagctccgaaaatcaatgcgatgatggccgaatggttccctttcaactcggcctcataacctaattgaggattgagatgaatcttctccaatggctccaaccgcaccccccaagtcttgtttttcaatgcctcttcagttttatacttctcggccaattgaggaaaagcacgttctatctcttctttgcgctcgggcgaatccagcaatacatatgtataggcttcatgtttgtaccaatactcctgtacccatttaggtaaggtggcatatgataaaagaaaattataatgtatatgcgaattagaaggcatttctttcatgattccagttacctcacaagacaccttccccatattgctgttaaaaataagtatcttcccgacagggtcttcatctctgaaatatttgcgggcaatccgttccgtaatcactacctgacatggcatggaaagacaagaagcgcggtcacctttcaacaattcaaaatcaaacaaacggaaaaagccaggatcagcgtatgctatcccattctcgcgcagacataattcgccatattttaccaattgctccggttggataatacatcctacacgagtataatcctcaattcccgccagattttcctgcatggccgaaccatatccgaatgaactggtcgcccaatcatccgtcagaacttccccctcatgaaaagtactttgcacacgataaatccgttcactcttactatgcattttgtcaaaactaaattcaaaagcaacgtaagtaaatatcaataaagctgatgccatgcctacagccaagccaaagatattgatgaagctgaaacctttcctcttcatcagattacgccaaacgctattccaataattttgtataatcataaaatttcaattttgctgtcagattccatagggcggttacgattctcggcaataattttaccatccagcaaacggattatacgatgtgcataagcagcatcacgctgtgaatgggtaacaatgatgatggtggtcccctgtttgttcagtgtactaagcagttccataacctccaccccattggtagagtccaaattacctgtcggctcatccgccagcaaaagcctggcattggtaactacggcacgggctatggccacacgttgctgctgtccacctgataactgttgtggcagatgattggcgcgatgcagcatattcactttttcaagcacttcttttacctgcctgttacgttctgtcggctttatattaagatacaccaatgggagttcaacattctcatatacagtcagttcatcaatcaaattaaagctttggaagatgaaaccgatatttccttttcggagagcggtcagttggttttcattcattttatccactcgctttccttcaaagagataggagcccgaagtaggggtatctaatgttccaagtatattcaacaaggtagattttccacaaccggacggtcccatgatagcgacaaattctcccttttcaatttcgaaagttacttcattcaatgctttggtctgcacttcctcggtgctgaacaacatagagaggttttctactttaatcattcttacgtgtgttttttattcgtttaaaatcagtttctcattatctccaaacagctcgtaaccggaaataataactttctcaccggaagccagcccgtcagtcacttcataaaactgaggattctgcctgccaatcttgataggacgtctgacggcaaatttaccactttcatccacaacatatatccatcgtcctccggtaatttgaaaaaaacctccccgaggaatcagaacagctttgacaggatcccccaactgaagattgatatgataagtttgtcccgcccgaatgttttcgggacgccctgtcgtgaaacggaaatctgtacgaaactgcccgtctttcacttcaggatacactttggttacttccaacttataattttctccatcacgggtaaagtcagcgggaagctcttggacgacacgctccacataatgctcgtcaattaatgcctgtaccttcagatcagcagtaataatctgaccgatatgttccccggcagaaatggattgcccgatttgtgcttcaagattacccacttgcccgtctataggagctttcactttcaggttttcaagacgttctcgtaccaatgccaaacttcgtttcatattcattatattctcgtccaaactgcttatctgagtcaaacgaaacaaactatcttgacggatccgctcatccaataccgacaattgttcttttaccgcttcatattcctccgtagcttggagatagtcctccctcgctatcaattgcccctccatcagccgcttgtattgtccgtaacgacgtttctttataatgaattctttctgaataccgatacgatcctgcttcagactcaaccgttcctgctccatacttatacgagtattacgcaactcattttcctgataggccagatctgcttcactttgcatgataccgatattcagcagaggattactcaggcgcagaatcacatcccctttctttaccatcgctccttcttcatgaaggcgttcctccactcttccgccttctatagcatcgaggtaaatcatgcggctgggaagtacttgtccaatcacacggacataatcattaaactcattttctgtaactgtagcgatagtgatacggctcttgtcaatggtcatggaagaaccggtatcacgaaaaataaaataaaaaacgaataccaatatgaataatactcccgcacctccataaatccgcctgggagtgaaacgctttttacgttcaattagtgtgtccatattttttaatggttaataaaacttcctgtccgataatacatagttagtcgcgatgtcagttcgtactgcaaacgcactcttattttttccgctttagcgacaagcaggcgatttcgtgcttccatcaactgaaacacggaaacaagcccttcctcccacttccgttccgtttctttcagcacttgcgtttctgcttttacctgcagggaagcctgtcgatgctcttcccatcccgaatgtaatgaaagtacaattcgttccgtttcattacgtaaatgtaacttctcttcctctatgctgttccgcacccgttgcaagtttaatttcttcttccttattccggcattccgatctaatccgctaagaatagggaatgaaatacctactcctatatatttattccaatggtcacgcaattgatgtaacgagaacaaggaattataaaaatcagatccccatgagaaacgggcgaagatagtcgggctgaactgtccaagggtcacagcatactccttacgggcagcgcgttcccacatttccatccgtttataatccggcagtacgtgtacggaccgtaaatagacttcttctacctctacttgaggcattaacaagagcgtatcctcactgactgataaagaaacagacaaaacatcgccctctttcatacccagtatttcctttaaataaagaaaggacatctgacgatttttttcatacatacgctctctgaacacatctccttgatgacgcgcttttacttcctgcaagtccgaaagcgatttcaaccccagttctacaaaagcttccgtctgtttcagataacgttctcccaaacgaagctgttcagctgccagttctgaaagctttttatccaataccgctttataataagcctcagctacccgataagccaaatcatttttctttgccagatgatcccactccttctcttttttagtccaatgcgtatatcgcaaacgattgatccgggcaaatccttcgaataaagaaagagttatatccattcctatagttccttgattatatgaatcggctgtatatccattagtatccggatcgacagaacgtccgatatgcctgcccacttccgcctgtactgaaacataaggaagaaatttacccatagcagccacatagtctgttcgtgcttcctttacgtctatttggacattcttgaaaccaggattatgtttccaagcataacgtatgcaatcgtccagtgtactttgcccacatacaggcaaagacagaccggacaacaaacacacaattatcaagttatttctcattgcattttaatttaaacacagaataggaagcaaacgatatgccaagaagatcagaacattaataatcaaccagttacaaaataaaatataaattagctgtccaaattttagacggtataacgtccaaattataaacactataaaaccagaacgaaccaaggaagatattggaacgctgacaacacggactgaagacacattccaatgtcaagtcaccgttatgataaataaaagcattacagaaaataataaaaaacgtccaataattggacgcctcatttgcagaaacaatcaaaagcagatacctttagcctctgaaagcaaaaatgagatggaaaaaggaacgattttaatagtagatgataataaaggagtattggcctcactggaattattactggaaacggagttcagcgaaataaagacagcccatcatccgaatcaaatcatatctatcataaatacctctccgatagatgtgattattcttgatatgaatttctcggcaggaatcaataacggcaacgaagggttatattggctgaaacgaatccgtgagatagctcctgcactacccgtagtcatgcttacagcatacggggatgtagaactggcagtaaaggctttaaagaatgatgcaactgattttttgttgaaaccttgggataaccggaccttagtgcgcaaaataaaagatgcttttggaagcggtaagaaaaggaaaaacagaatccccgatagaaacaaatcaccgatgattgtgggaacatcccctgccatgcagcagttaatgaagatagtagtgaaagtggcacgcacagatgccaatatattgattaccggagaaaacggaacaggaaaagaaatgctggcacaggaaatacaccggctttccacacgaaaggaacattctatggtaacggtagatatgggagcaatcagtgaatctttattcgaaagtgaactgttcgggcatgagcgcggttcttttaccgatgcctacgagagccggccgggaaagtttgaagcggcatccggcagttccctgtttatggatgaaataggaaatctccctttagccatgcaggcaaagttgctcaccgtattacaaaaccgaaaaattacacgcatcggcagtaataaagtaatcccagtggatatccggctgctttcagctaccaacaagaatattcaggatatggtggattccgggactttccgtgaggatttattgtacagactgaatactattcatctggaaatcccgcctttacgcgaacggagggaagatatacatttgttcattaattattttatgcagcgctatgctgctaaatacgaaaaaaaagaaatcttcctgcatgaacatgctttagagaaattatgttcttatcattggccgggaaatatccgggaattgcaacataccatcgagaaagcagttattttatgtgaaggagatgtaatccgttccaaagacattttcgtaaaacaaacctggagtccacaattctccactaccgttcctaatctggaagaagtagaacgccaggccatagaaacagccatccgtcaaaacgatggaaatctgacagcaacagccgaacagttaggcatcagccgccagacactttacaataaaataaaacgctttaagctctgatgatcatggtattcagcaaacatctatatatggttatcctaagctacatcttattaataattgctgtagccggagctggtatcgcacttattattacacataccgcccttattctaggctgtcttttcttgattatttcacttttttttatcagagctttggtaaaacaattgaataaattcaatgccaaaataagaatattcttggatgcgatggaagataaagagagcatgatactgttcaacgagcaatcggcagataaagaaatgaatgcacttagccattcactaaaccgaatcaatgaattgcttgccacaacgaaatcgcaaagccgggtacaagagaacttttatcactctttactggaagaagtaccaaatggagtgctagcgtggaactccgaaaaaagagttctgtttgtaaatggtgcagccttacgtttgctgggagttgagtcaatcatattcctccgccaattggaagagcaatatccgatcttgaaagatttcataacccatggaaatgtggaaaattcctttcttttacaatctaactcaaaaaaacaactgtcactatccatgaaccggatgaaactaaattcagaaacgattaccctgttggctatcaaagatatcagtaatgaactgaacgagaaagaaagtgagtcatggaacaaacttacccgggtgcttactcatgaaattatgaataccattgctcctattgtttctctgtctcaaacactttcattgcgccccggtacggacgagaaagtaatacgaggacttggagtgattcgtgaacaaagcgaaagactgatggaattcacagaatcatatcgacgcttatcgtatatgccggaaccgaaaaagaagcgattctcactgaccaattcattgcacaatctaggtctgttactacaatctgattttgaaaatgctcatatccatttcattctgcgtagcaccccctctgatatatatattgagggcgatgagaagcaactctctcaagtttttttaaatctgctgaaaaacagtatgcaatcattggaaggaaaaacagacggacaaatagaagtaacactggaagtaacaaacaaactttatataagactacttgacaatggacggggaatccctatggaattgcaagaaaaaatattcgttcctttctttaccacaaaaacagaaggaactggtatcgggcttagtctgtgccggcagattataaaaagacatgggggcaatttctatttacaggaaagcagacaaggaaaaactatatttgttatagaatggcccgtagcttcttttattttgaaataacaaagttcattacaggatcactctgattaacacaggttattcttaaaagtaaggcggaaatataaaataataaccacttatctataaaccagcgttaacctgagtaatccgtaatgaaacatttttttatttctttatcctcagttcataaaggtcattcctgcggtcacgcaaattgcgcacactgccatacgtatgcaattcattcaacagattcagatcaacatccgaaactaaaatcatttcggtattcggagtcgcctcggcccgtttgccatcagttgggaaagcgaaatcacacggagtaaacactccagactgtgcatactgaatatccatattgtgcacacgcggcaaatttcccacactaccggctataacgacaaaacattcattctcgattgcccgtgcctgagcacaaacacgtacacgggaatagccgttctgagtatcggtgaggaatggaacaaacagaatctgcattccctgatcggccatgatacgagagagctcgggaaattccacatcataacaaatcaagataccaattttagcacaatccgtatcaaaagtctgcaccatcttaccgcccgagaggccccaactctttatctcatcgggagtgacatgtaccttttcatacatttcgtatgaaccgtcacgccgtactaaaaaaccaacattataaagccctccgtcctcttttacgtatggcatactacccgtaatgatattaatattataactgatagccaaattgataaaacggtcgcgaacctcttcggtatattgtgccaaaccacgaatgctctgggcttctcccaaatgattgaacttggccatcaacggcgcattgaaatattccggaaaaagaacaaaatcactcttataatcggaaacggcatctacgaaaaactcaacctgctcaaatacatcatccaatgttttataagggcgcatctgccattgcactaaccctacacgtacagtggttttcttatccacataatcctgcgtaggctcctgataataaatattatcccattgcaacaaagtggcacaatgcttggattcttcgtcattgggaagataattcttcatgacacgacgcacatgaaaatcattggaaagctgaaatgtcaataccggatcataaatctcacgggaacgcaccttatccaaatattccttaggacgcatcgtatccgcatacttataataattaggaatacgaccaccgaacatgatcgctttcagattcagtttctcgcataattctttccggtactcatacatacggcgtgccaaacgcaaaccgcgataatccggatggataaacacctcgataccatacaaaatattcccttccggattatgcgtacagaaagtttcattaccagttactttggcataggtatgatctccctttaccatatcatagtctacaataatagaaagagcacatcccactatcttatcgtctaccaccgttactacttgcccttccggaaaaatccggataagcgtttctatttgctcgtgtgtccaaaacacatccttatccgcatacacccgcttgaatgattgtgataattggatgtaatcttcgatctgtaaattccggacctctactttattaattttatgcatcggttccataatgattctcttatttatattttaaaacagcggtgcaaaggtaggacaaattataaaacgatgttctcccaaacagaaaaagataaagagaatatcactcagtatgaaagaaaatatctatgaacttttcataggattttcagaaaactttttgttatctttggaaagttaaccaaataacaaacaaaaaacaaccaattttgctatgaataaagaattaataatgaaccccaaccaattggtggcatttctagaaaaaccttgtgcagagtttaccaaagaagacataaaacgatacattcaacagaatggcatccgtatggtcaactttatgtatcccgccggagacggacgactgaagacattgaatttcgttatcaacaaccaagcatatctagatgctatcttgacttgtggagaacgtgtggacggttccagcctgtttccattcattgaggcgggcagcagtgatctgtatgtaattccccgattccggacggcttttttggacccgtttgccgagatacctacactttccatgctttgctctttctttaacaaggatggagagccattggaaagttcccccgaacataccttacacaaagcatgcaaggcattcaatgaagtaaccggcatggaatttcaggctatgggggaattagagtactatgtaattgctccggatacaaatatgttcgaggctacagatcagaaaggctatcatgaatcagcaccatatgccaagttcaatgatttccgtacccagtgcatggcctacattgcacaagcaggcggacaaataaaatatggacattccgaagtaggtaattttaccttgaatggcatgatatatgaacagaatgaaatagaattcctgcctgtcaatgccgaagatgcggcagaccaattgatgatcgccaaatggattatacgtaatctggcctataaacatggttataacattactttcgcgcctaaaataactacaggaaaagctggttccggattgcacatccacatgcgtatcatgaaagatggacaaaaccagatgttgaaagaaggtgttttatcagaaacagcacgcaaagctattgctggcatgatggaacttgctccatccatcaccgcattcggtaataccaatcctacttcttatttccgcctggttccccatcaggaagcgccaactaatatttgctggggtgaccgcaaccgttcagtattggtacgcgtacctctaggatgggcagctaaaacagacatgtgcatgactgccaatccactggaaacagaaagccattatgataccacacaaaaacagacagtggaaatgcggtcaccggacggttcggccgatctctaccaactgatagcaggattagctgtagcctgtcgccatggatttgaaatagaaaatgcactggacattgcagaaaaaacttacgtaaacgtcaatatccatcagaaagaaaatgcagacaaactgaaggcattagcccagcttcccgatagctgtgcagcttccgcaacctgtttgcaacaacagcgcgaaatattccaaaaacataatgtgttcagccccactatgattgatggaatcatcagcaaattaaccagttataacgatctgaccttacgtaacgacttaaaagataatccggaagggatgttggcattggtcaataaatatttccattgcggataatttgactaaaacagcgggaggagggtatatcaatattttgatttgaccttcttccgttttctaacatttacaccatgataaataaaaaagatcaatgtacttctacactgatcttttctcttgagcggaaaacgagactcgaactcgcgaccctaaccttggcaaggttatgctctaccaactgagctatttccgcaaacctctaacatggtgcccagaacaggactcgaacctgcatgcctctcgacacacgcacctgaaacgtgcgcgtctaccattccgccacctgggcattctgtgtaacactcttgtcacaacgcacaagattttatttatgtgagcggaaaacgagactcgaactcgcgaccctaaccttggcaaggttatgctctaccaactgagctatttccgcaaatatcttctcttcgtgaaggaaatgagactcgaactcacacgacataattgtcaccaccccctcaaagtggcgcgtctaccaattccgccattcctccagaaacgaaaacctcgtgtgtagtgcccagaacaggactcgaacctgcatgcctctcgacacacgcacctgaaacgtgcgcgtctaccattccgccacctgggcattctgtgtaacactcttgtcacaacgcacaagattttatttatgtgagcggaaaacgagactcgaactcgcgaccctaaccttggcaaggttatgctctaccaactgagctatttccgcaatttccgctttcggttttaactatttcccagctgtttcccgattgcggatgcaaaggtagtgcttttttctaaacttccaaaaattttctatactttttatagtacttttattacattatttcatcaaactcctcatagtcaatataaaccaaaagttttttttacttactatcaagacatacggtcacgataatcctcatatcggaagtctttatatacttccaatgtattatctgtatgccaaatagcaatagaagggtgatggattccattaaacatgtttgtttttaccatagtgtaatgaatcatatcttccaaaacaatgcgttctcctatctgtaacggatggtcaaaacaccagctacccatatagtcgccacttaagcaactgtttccacccaaacggtaaacattctcttccgttaaagctgtttttatcgcatcgactggtaaagttttggcaccacgcactgccggctgataaggcatttcaagacaatcgggcatgtgacaagtaaagctaacgtccaaaatcgcggtttttatcccccggttttccactatatcgacaacagaagctaccaaaggtccggtctgccaagtaaaagccgaacccggttctaaaataatctccaaatgaggataacgggctttcaagttttttaataaagaaataagatgctccgtatcataatctttacgtgtcatcaagtgtccccctcccaaattcaaccattttatttgtgggaaccaagaagcaaacttctcttctatgtgctgcaaagtatgctctaattcataagaactggattcacaatgacaatgacaatggaagccctcgatgccctccggtaaagtttcaggaagcaaatcggccgtcaccccaaaacgcgtaccgggagcacaaggattataaagttccacctctacttccgaatattcaggattgatgcggataccacaggttatcttttctccaaaggcctcaaccataggataaaaacgccggaactgactgaaagaattaaaggttatatgactgctgcatcgcatgataaccggaaaatcagtatccgtatacgccggagaataagtatgggccttactgccaaattcttcatacgccaaacgggcttcatatacggaactggctgtagtataacgaatgtattccctgaaaatggggaatgatttccacatggcaaaagacttgaaagccaagatgatctcaactccggctcggtctgccacactctttatcaaactcagattctttctgagcaatgcttcatccattacatagcatggagaaggtactttatggatatctatcatttttgtatcagaattctattaaaatatttattctattccacaactttgaatcgggcaaatttcagtaataattgtttttctccggcattccggaaacggacagtcgctttgctgttctcaccaattccttccacctttatcacatcgcctattccaaaacgctcatgctctatcacctgccctgcctgtacattcaccgacaagtttctcgctgcggacggctttgagaccgtttccggaccaaccttggtcaaattacgtggtatactgggacgaataatctcaactttcggtctttctccaactaaaaatgttttctgaccaccagagatgttcgatgaagaacgcccgtaagaagactgagaagcaggttcgtcaaacaaggaacgagccgcacgttcattttgctcacgacagaaacggctggctctctcgtctattctccgggccatctgttcctcctgaggtaacttcaggaaatgtacatcaatatctttcaagaaacggctagggctactgaactccatctttccatatttaaaccgactcttggcaaaagacaaatagcaatgctcttcggcacgtgtaatcgccacataaaacaagcggcgctcctcttccagctccttatacgaattgagtgacaaagcactgggaaacaagttctcttccatcccaactacaaagacgtttttaaactccaagcctttagcagagtgaatggtcatcaaggtaatcttctcggcatccccctctttctcgttatcctggtctgtcaacagagaaacctccgacagaaaatccgtcaacaggatgttttcattcccttcttcttcacgggttgcacaaaaatcgtgcataccgtttatcagttcttcaatattctcctgacggctcagattttcaggatcattgctctgataaatctcattcataatgccggactgacgaacaatcattgctcccaattcgtatgcattcttcttcgggacctccactataaaactttctaccagttcacgaaacccctgtaatttagtatgcatacccttgttaatattcaagccgtatgccaacggctcttccaaaaccatccaaagactgacatgatgctgtgcagccgcatcaatgaccttgttcaacgtagtatccccgattcctcgcgccggataattcaacacccgcttaaaagcctcctcatcattcggatttaccgccagacggaagtaagatataacatctttaatctccttgcgttgataaaaagaaagccctccgtaaatcttataaggtaaagcacgcttccgcaaagcctcctcaaaaatacggctctgagcatttgtacggtataaaatagcaaaatcattataagaataatgttcccgcgaacgcagtttcacaatctggttggcaacaatctccccttcctccacatcactgtaggcattgaaaactccgataggctcccctttcgctttttccgaaaatacctccttccttatctgctcgctatttttctctatcaaactgtttgccgcgcatacaatggtctgggtagaacgatagttctgctccaatttaaaaagcttggctcccttatacagctgagtaaatttcaatatattgtcaatattagcccctcggaaggaataaatactttgtgcatcatcccccactacgcatacacgctgatgttcttgggtaagctgaagcacaatgctgtgttgcgcaaaattagtatcctgatactcatccaccagcacataacggaactgctccgcatacttacggcagatttcgggatgatcgcggaataacatataagtataaaccaacaaatcatcaaaatccatcgcatcgctttggcgacaacgttcccaatatcgtcggtaaatatcacgggtagcgggtactttggcattcagatcatactgataaagctctgcgttcgaaacatatgcatcgggaaaaaccaaatggtttttcgcattgctgatacgcgcctgtatcacccccggtttataggttttatcatccaattgcatttcttttacaatagacttgatcaaactcttcgaatctgaagaatcatagatggtaaaattggaggtaaagccgacagcctgtgcctcacaccgcaggatacgcgaaaaaatggaatggaacgttcccatccataaatagcgtgcctgatcgcccacctgacgggctatacgctctttcatttcacgagcagccttattggtaaaagtcaatgccagaatagaccaaggagtatatccccgctccagtaaataagctattttataagtcagtacgcgtgtcttccccgaacctgctccggctatcaccaaagagggaccttcgttgtaaagcaccgcattgcgctgactttcattcaattcttctaaatagttcgtcataaatttcacctttcgcccgcaaagatagagaaagtttgagtttatcagaacaattctatgctcaataatgttattatgatagaagtttaattaaaacctcgactaaaaatgaatatattattaaccactttaatttcattagttatgacttacgaaatgcccaaactcccgtatgcaaacaacggactcgaacctgtaatcagtcaggctactatagactaccattatggcaagcacttacaaacatacgtaaacaatttgaactctttggttccgagtacagaatttgaaggaaagaccgtagaggaaattgttgcatcagctcccgacggagcgatattcaataacgccggacaagtattgaaccatacattatatttccttcagttcacccccaaacccaacaagcatgaaccgtccggcaaattggcagaagccatcaaccgggacttcggaagctttgaaaacttcaagaaagaattcaacgccgcttccacaggactgtttggttcgggctgggcttggctttctatagacaagcaaggaaaactacatatcaccaaagagccaaacggaagcaacccgtggcgtgcaggcctgaaaccattgctgggtttcgatgtatgggaacatgcttactatttggattaccagaaccgccgtgcagatcatgtgaacaagttatgggaaatcattgactgggatgtagtagaaaaacgtctataaaagaacccttaactatacatcataataaagctgcctcgcaccctattcattcagggagcggggcaatctgctttaagatgcaaagatacagcagatatgcattcatccttttacaagaataaacaagcataatgcaagataatcataaaaaaacattcttccacaaaaaataaagcagtctgttgtagcattattcatttctttcccatatctttgccatcgtaaaacaaaggggtgccccacgtaaacagcggacgggctgagattataccctgtgaacctgatgcggttagtaccgccgaagggattgttacttcttacctcataccatccggtcaaaaagcaactctttgtatttacaagtaaattcataaactgatatagtatgaaactgacagtaaacagcaaagaaaccgaagtaaaggacggatgcaccatagccgaactttccacctttctggcacttcctgagaaaggtatcgccatagcggtaaacaaccggatggttccccgtatagagtgggagaaatgtgtgttacaccccaatgacagtctggtagtcattaaagctgcatgtggaggataagaccgtggaacttcaattcatcactcacttcaccgacacatattcctattatgattccgcacgcatggccttggaaggcggttgccgctggatccagctacgcatgaaagacactcccgttgacgaagtggaacgggaagccatacgcctgcaaggcttatgcaaagactatggagcgacatttatcatagacgaccacgtggagttagttaagaaaattcatgctgacggagtgcatttaggaaaaaaggacatgcccgtagccgaagcacggggaatattaggaaaagaattcattatcggaggcaccgccaatacatttgacgatgtaaagatgcattacaaagccggagctgactatatcggctgtggcccgttccgttttactactacaaaaaaggatctctctccagtgctgggactggaaggttaccgttccattattctgcaaatgaaagaggcaaatatccatttgcccatcgttgctatcgggggaattactttggaagatatcccttccatcatggaaacgggaatcaccggtattgccttgagcggaaccatactccgggcgaaagacccggtagcggaaactaaacgaatcatgaatttataataaaatcacaaaatacaatgaaaaaactgattatagctggaaaagaatttaattcccgtttattcctgggaaccggtaaattcaattcaaacaccgtaatggaagaagccattctggcatcaggatgtgaaatggtaaccgtagccatgaaacgcattgaactggacgataaggaagatgatatgctgaaacatatcattcacccccacatacagctattgcccaatacctccggtgtgcgcacagccgaagaagccgtctttgctgcacaaatggcccgcgaggcctttggcaccaactggctgaaactggaaattcatcccgatccgcgctacttgttgccagattctaccgaaacattgaaagcaaccgaggaactggtcaaactaggtttcgtcgtattgccctattgccaggcagatcctacattgtgcaaacggctggaagaggcaggagcagcaaccgtcatgccgcttgccgcccccatcgggacaaacaaaggcttgcagacacgtgacttcctgcgcatcattatcgaacaagcttccgttcctgtggtagtagacgccggaataggtgcccccagccatgccaccgaagcgatggaaatgggtgcggacgcctgtctggtcaatacagccatcgcagtagccggccagccggtagaaatggcaatggccttcaaggaagctgtcattgccggacgccgcgcttatgaagcaggcttaggagcggtaggacagaacttgatcgcatccgcctcatcccctttaacttcattcttagattaaacagaaatatgatagacaaaaagcaagataaaaaagcatacgctcatgcagaaaaggcatatatgcaaggaaccctgttcccatacatcaaagtaggaatgcagaaagtaaacctgactcctactgtgaacatagtgaacggtgaaaaggtaacaacgcccaatgctcctgtttatatttatgacaccagtggtccgttcagtgatcccaatatggaaatcgatctgaaaaaaggacttccccgtatgcgcgaaagctggattattggacggggagacgtggaaaaactgccctccattacctcagaatacggaaagatgcgccgtgacgataaaagtctggaccacctgcgctttgaacacatcgccctgccctatcgtgccaaagccggaaaggccatcacacaaatggcatacgccaaagccggcatagttacaccggaaatggaatatgtagccatccgtgaaaacatgaattgccgggaactgggcatcgacacctttatcacccctgaattcgtgcgtgatgaaatagccgcagggcgtgccgtacttcccgccaatatcaaccaccccgaaagcgagcctatgattatcggcaggaactttttagtgaagatcaacacgaacataggaaactccgccaccacttcctccattgacgaagaggtggaaaaagccgtgtggagctgcaaatggggaggtgataccctgatggatctctcgaccggcgataacattcacgaaacacgcgaatggattgtccgcaactgtcctgtccccgtaggtaccgtacctatttatcaggcattagagaaagtaaacggtaaagtagaggatctgaattgggagatttataaagatacattaatcgaacaatgcgaacaaggagtggactactttaccatccatgccggaatacgccgccagaatgtacatttggccgacaaacgtctgtgtggcatcgtaagccgcggaggcagcatcatgagcaaatggtgtctggtacatgacaaggaaagtttcttatatgagcattttgatgacatctgtgatattctggcacaatacgatgtagccgtatccttgggtgacggacttcgtccgggctgtatcgctgacgctaatgacgaggcacagtttgccgaactggataccatgggtgaacttgtactccgagcatggaacaaaaacgtacaggcattcattgaaggaccggggcatgtacctttgcataaaatcaaagaaaacatggaacgccaaatctctcactgtcacaacgcaccgttctacactctcggtccgctggtaacggacatcgctccgggatatgaccatatcacttcggccatcggtgccgcacaaatcggctggttaggcactgccatgctatgttatgtcaccccgaaagaacatctgggattgcccaacaaagaagatgtacgcataggtgtcatcacttacaagattgctgcccatgcggccgatctagcgaaagggcatccgggcgcacagatccgcgacaatgctttaagcaaggcacgttatgaattccgttggcgcgaccagttccatctgagtctggatcccgaccgcgctttggaatacttcaatgaaggccgccatacggacggtgagtactgtaccatgtgcggacccaacttctgcgctatgaaactgagccgcgacttgaagaacgtgggtaattaaacaaccgactttgtaaaaactatggaagatttcaagaaagcacttgaaggaactttaggaagaaaacacatagacaacatagtagatcaagtggccagcttccccgaccgctttgatgctctttatactctaacgcagcatgaagaaacaaggatagcctggcgtgccacttgggcttgtgaaaaactgagtttcctccttccttccctattgatggataaaagggaggaactgattacgggccatgcaatgcccccacgatggaacaagacgcctgctactgaatatccttcatcatcttcctgtcccgaagcctgtcaacgcagctttcttcgatttctgccttcaaggtatgctatcttctgccgaaagcgcatccggacaagccgtctgcatgaaacttgcctacgacatctgcctggaagaaccggaactgacaggagagctgaaagcatatctggaaaatatggaaccggaatactatacggttgcagtgcaatgtgtccgcaacaacatcctaaaaaaaataaggtaatgaagatattgatactcaacggaagtcctcgttgccaaggacttatcagccgaatgctggacatcatggccgaagaagctcgcatacgtggcgccgaagtggaagcaatatccatccataaattgcaggtacgcccctgtacaggatgcatggcttgccgcagccggcaggcctgtgtcctacccgaagacgatgcgcagcgcacgcttcaaaagatacaatgggcagacgtgctgattgtcggttcaccctgttattggggaaatatgaacggacatctgaaagtagtgttcgaccgcatcgtgtacggcatgatgggagaaagtccgaaaggactcccccaagcgttgcataaaggcaagaaagcagtcatcgtaagcacctgctccaccccatggccgttcaatatctggtttaaccagacacgcggtgtagtaaaagcgttgcgcgaaattctgaagtggagcggattctctatcaaaggcgttatccagaagggaggaacgaagcaacatcccgagctgacggaaagcgacaaaaagaaatgtagaaaaataataagaaacttatagcttgaaacctgtttaaatgccgaaaaagtttaaataggctcttatagaagcgaaatcatcttatagaactataacaaaaataacaattatgttttcagaagaacttgaaaaaatagattgggaggaaaccaccaaaaccatctactccaagaccgaaagtgatgtgctccgcgctcttggcaaggaacattgcgatgtggacgactttatggcgctcatctcccccgcagcagcaaaatacctggagccgatggcgcaactaagcaaaaaatataccgaagaacgtttcggcaaaaccatctccatgtttataccgctgtatatcaccaactcctgcaccaattcttgtgtgtattgtggtttccatatcagcaacccgatggcacgtaccatcctcacccccgaacagattgaagatgaatacaaagccatcaagaaactggggccttttgagaacctgttactggtgaccggagagaatccggcaaaagccggagtcccttatctggctaaagctttggacatcgccaaaaaatatttcagcaatctgaagatagaggtaatgcccctcaaagccgaagaatatgccgaactgaaagaacacggactgaatggagtcatttgctttcaggaaacttataacaaagcccgttataatatatatcacccacgcgggatgaaatccaaattcgagtggcgggtaaacggcttcgaccgcatgggtcaggcaggagtccactccatcggcatgggagtacttatcggactggaagaatggcgcaccgatgtgaccatgatggcttatcacttacgctatcttcagaaaaagtattggaaaaccaaatacagtgtcaacttcccccgtatgcgtccggcagaaaacggtggtttccagccgaatgtcatcatgaatgatcgtgagttggcacagctcacttttgccatgcgtattttcgatcacgatgtagatatctcctactccactcgtgaaccggcacaaatccgcgacaacatggcagggctaggagtgactaccatgagtgctgaaagcaaaactgaaccggggggatactatacctatccgcaagctttggaacaattccatgtaagtgatgagcgtacagccgtagaagtagaacacgcactgaaatcattaggaagggagccggtatggaaagactgggatgtttcttttgacaagttcacgccaatacgatagattttacccatatttttaaaggaatggggctgtataaatgatacaaagctcctttttttcaaattaacaacaaacaaagtggaaagatataaccgtcaaattattctccctgaattgggagaaaaaggacaacaacggcttcagcaggccaaagtgcttattgtcggtgtaggtggtctggggtctcctgttgccttgtacctgacaggagccggagtaggtaccatcggattaatagacgatgatgtggtaagtgtcagcaacttgcaacgtcaagtactttatagtgaagccgaggtaggcatgcccaaagctatccaagccaagaaacgtcttgaagccctgaaccatgatgtacaaatcaatgcctatcccacaagactgactaaagagaatgcggatgaaattatccgtacctacgacatcattatagatggatgtgataatttcgctacccgctatcttatcaatgacatctgtgtgaaatggggaaaagtttatgtatatggtgccatccgtgccttcgaaggtcaagtatccgttttcaattaccaaggaggccccgattaccgccactttttccccgacgaaacagaaatgctatccatgccccatccgcccaaaggagtattaggtgtaacccccggcataataggttgtgccgaagctgctgaagtgttgaagattataggtgaatatggcgaagtgttaagcggcaaattatggacgattaacgtaaaaacgatggaaacccatctcatttccttctagaggaatcgaaccgaccctattcaaaagacattaattcctcaattatgtgccaacagtcgaggcatgacgacatccgtcgtccggcatcgaccggcacatgaatagtttgactttatcctataatatgtggtacaaactcggacaagttatctgtaacctccatacgattttcgcgaataccgatgcccgcagcttctcctcctataatccaagaaccaataactggatatctgccactgtacgctgtcggttccacatactcctgatatacataagctccagtgttataatcaccctccgtttcagctatacgtacatattcctcccaatcccggatatcaacaacgcttacattatgaccttcacgagagaagatcggttttttacaaaacaatcccgaccgagggcgcgacaaataacaaggaagcacataaggagaatccggaaacaactcgtacaatgtggcaaggatcgccttattggacatcaccaatttccatatcggctccaaccattccatttccgctagacatccgtcaggactttcgtccaccatccactcccacggataaagtttaaagcaccggttcactagttcacctgccggatcaaaaaatcgtccattttgcaaatccagcgcctgcatatccaatactcgggtagaaaacccagcctccatcgccgtacttgccagatattgcaacgttcctgtatcttcattattctctaatgcaccagcaaaatgaatctctccttttttggggaaaatatctttccatgactgcaccaatccttcatgaataccattaaactggtcgcattccggaaaaacatcctctttccattgccattggataacagatgcttcaagcaaagaagtcggtgtatcagcattgaactccaatattttcggagtaccatccttggctaatataaaatcaaaacgaccatacagacttaactcatccgcaccccaagaagcacggatacgctcaccaatctccttcggaatattcaatgcacgctccataaattccgggttatcttcaataatgaattgagcagcctcacaatacagacggtacgcctcattggttgcttcctccaaacaggctgtttcttcagccgtaaaacgataatacgcttcctcgcgccaataatcaccatgaaaatcaaagcccagcacttctattttctcacggtagtctgaacgtggcgtaacaggtattcttttcatatccgcttcctattaactatgaacaccggatgaacggcgtgttttcccaaaaacacttccgctcgattttgattttgtagacgattttgcccccacattcacttttgaaggagcatccactttcattccgttagcatctgtccacgaatcagatttaggataataataatgtgtggtagaaagtccgttggccatagacggcattaatgcccaacgcattagcatagcgttataaatccaactgtttccctgatgatcacggtactcttcttgatctttaggattctcaggcaattccgttttttgcgtacatccggcaagtgccatcaaacaaaatgcggctgcaagaaattgttttttattcataattctatctattcgtcttgttttattagcgcaaaagtaaataaaaaacgcctatttcatacagatacacacagattatttaaaacttttccatcgcatgaatcactttttcggggaaagtatcccattgatttacaggtttatcaaaaataaatctataaatccactaggattattacaaataggttgctatctttgcttagcaattagtcataaggtatgaagttaattctaataacgccccccacttattttgtggaggaagataaaataattacagctcttttcgaggagggactagacacactccatctgcgaaagcccggtacagcacccatgtttgcagaacgtctgctaacccttatccccgaacaatatcacaaacgcatcgtggttcacggacatttttatctgaaagaggaatacaaactgaaaggaattcacctgaacggtcgtaatccgaacctgccggaaggatacaaaggacatgtcagttgttcttgccattcgctagacgaagttaaagagcgcaaatccagttgcgattatgtctttctgagtccggtattcaatagcatatccaaactaaattataactcggcatacaccgccgaagaactccgtaccgccgccaaagcaggcattattgacaaaaaagtcatagctttgggaggcattgacgaagaaaacttgctggaggtaaaggactttggtttcggaggagccgccatattgggcgccctttggaataaattcgatgcgtgtaccgatcgcgattatcggtgcgtgatagaacatttccggaaattaagagatttagcagactgatttatcaaaataatttagaatagaagcctaaaaaacgaagaatatgcttcaaaccaagcatattacaataatgagaagttatttttaaatttctatttttaatttctaattataatacgtacctttgcacgcaaattaacaaataggtaatatctattacaaaaatgagcaaaacatcaccttttagggtattctcaggaacaaattcgagataccttgcagaaaagatttgcaacagcctcggttgcaaattaggaaacatgaacatcatgcattttgctgatggtgagttcgctgtttcttatgaagaatcaattagaggcgcacatgtttttctagttcaatctacctttcctaactctgacaacttaatggaactgctgctaatgattgatgcagctaaaagagcctctgcaaaaagcattgtagccgttattccctactttggatgggcacgtcaggacagaaaagacaaacctcgtgtttctatcggtgctaaactggtagccgatcttctgagcgtagcaggcatcgaccgtttaatcacaatggatttgcatgccgatcagattcaaggattctttgatgtaccggtagaccacctctacgcttctggcgtattcctgccttacattgaatcattgcaactggaagacttggtaatcgcaactccggacgtgggtggttcaaaacgcgccagcacttattccaaatatttgggtgtacccttggtactctgcaacaagacgcgcctgaaagccaatgaagtggccaccatgcaaattatcggtgatgtaaaaaataaaaatgtcatcttaattgacgatatggtagatacagcaggtactattaccaaagctgccgatattatgaaagaagcgggagctatttccgtccgcgctatcgcttctcactgtgtaatgtcaggtcctgcatccgaacgcgttcagaactccggcttggaagaaatggtatttaccgatagtattccttatgctaaccgttgctctaaagtgaagcaactgaccattgctgatatgtttgctgaaacaatccgccgcgtgatgaataatgagtctatctcttcacaatacatcatttaatctttatatgattatagaaataaaagtccggactttcccaagttcggacttttattttaattctacctagggacattcattaaatattacaaaatcagccaactaattcatacacaaagtattgcaatactttgtgtatgaattagttggctgattttgtaatatttaatgaatgtcccaaacaaaaccggaaggagaaacaacaggttttcttcttccggtttttgtttgtagggacatttactgaatatcccctttttatttataaaagaagttctcttttttcttatttggcaatcaccagataatagttcttctttccgcgctgaaccagcaggtatttttcatccagcaggtcagcagtcgtaatcacctggtcaaaggcacttaatttctccttgttcaatgaaacgccaccgccctgtacaagcttacgcatctcacctttagaagcgaaaacagcggcattatcaacgaacaagtctactgccttcacaccttcggccaatgcatctcgtgacacctcaaactgaggaacaccttcgaacactgccagcaacgtgtcttcatccagctttttcaacgcttcggaagtggcgttaccaaacaggatgcccgatgcctcaacagcagcattgtaatcttcttccgaatgaaccatcacagttacttccttagccagacgcttctgcaatacacgcaagtgcggagcttcagcatgttctgctgtcaatgcttccacttcttcctgactcagcgaagtgaaaatctttatataacgtgcggcatcctcgtcacttacattcaaccagaactgatagaacttgtaaggagaagtataacgggggtccaaccaaatattaccagactcagtcttaccgaacttaccaccatcggcctttgtaatcaacgggcaagtcaatgcaaacacttcaccgccattggtacggcgaatcagctcggccccggtagtgatattaccccattgatccgaaccacccatctgaagtttgcagccctttgtttcataaagatgcaagaaatcgtatccctgcaacaactggtaagtaaattctgtaaatgacaaaccgtcacgcgcctcaccgttcaaacgtttctgtacagaatccttagccatcatataattcactgtaatgtgcttccctacctcacgggcaaagtccaggaaagtaaaatccttcatccagtcatagttattcaccaattcggctttgttaggagcatcgctctcaaagtcaaggaacttagccagctgtttcttgatgcaagccacattatgacgcaatgtttcctcggtcagcaaattgcgctcctgcgatttgccggaagggtcaccgatcataccggtcgcgccgcccaccaatgccaacggcttatgaccgcaacgctggaaatgacgtagcatcatcacaccacacaagtggccgatatgcagagaatcagccgtagggtcaatacccagataagctgtcacttgttctttagccaataactcttcggtgcccggcatcattgtgtgcaccattccacgccatgttaattcttctacaaaattcatcgaatgattatctatttaaatgtttgatttatactttaaatgccacaaaagtacgactctttatctgaagaaacaactcttattgccgaaaaaagattttccgtgcattttcatctatcctatcgcacagaaaggaaacttccacattcttcgtttccgccatccgtcctatcaccatacggatatcctgcgtgctctcatccgtttcggccaataaacattctaaaggcacgtgccgcaacacatcaggctgatatctttctcccaacgaaaaataaatgttttcctgcatcagccggcaggcaatatgcagattattacggaaaccatgtaccacccaaggcatctgcggacgatacttctttttcagttcaatcagttcattaaacgccttcacacaatgaataaccaacggttttcctactgactcgctcaataaaatttgtcggacaaacacctctttttgcaacagaatatctgccggacccaaacggtccaaacccgcctctcctatcgccagaacagagggatgacagaccgccttttccaacgttgtccaatcttccggaccagcttccaaaactttccacggatgaatgcctatagaataataacacccttccacaggttcaaaccatgcaggctctacattgaaaatgcattctcccggtacagcagcattgcgatgcgtatgaatatccagcaacataaggacaacagattttacggaaccggatcatagcccgacccgccccacggatggcaacgcaatatccggcggacagccagatacaatcccttgaaaggaccatgttttttaatggcctcgatggcatattccgaacaggtaggtacaaaacggcatgaaggaggagtcattggagaaatgtacccccgatagaaataaacaggcaacagcaacagataggaaagtatctttttcattccagcctttccactatatgaaacagcagtttcttcactttctcctccacttcggcagaagaatgaatatggttatccagccatataaaggcgataatcagtcttttgttccgggaagccagcgcatccagcaacaaatgcttgttcttccgataagcctcacgtacctgacgtttcaccaaattacgctttaccgcacgtttgaaccgcttcttgggcacgctgatcagaatggaagctgccgccatatcttcctccacaggctctaccgacatatacaccacacgtagcggaaaagccggaaaagacttgcttccacctgaaaaaagacgctcaatcaatgtcttactattcagacgctcttttttaccgagtgtatattctaccataatcttctttcttttattaaaataaagaaaccgagggtttcgaatcacaaagttacaactttattgatacaaaacccccggttttgggatataaactaaaaattaatccttattacgctcgcggataaacatatccaatgccgcagtcatggacggagcctctacagtaggagcttccagatccaaccgcaatccggcatcctttaccgctttagcagtagcaggaccaaaacatcctatcgcaatttccttttggtcgaactccggaaaattcttcatcaaagaattgattcctgcaggactgaaaaacaacagcatatcgtaatcgaactcttcttcaggagtgaaatcattacttaccgtacgatacatcactacctccgtatgctgaattttatttttatccaataaagtcttgatctcatcattgtgtacatcagacatcggcaccaaatatttttccgtgttgtgctttacgatagaaggcaccaaatctgcgaatttaccggtcgcgccgaagaacactttacgcttacgatactgaacatatttctgaatgtacaaagcaatggtttcggacgtacagaaatatttcattgtttcgggcacagtaacacgcaattctgtacacagattgaagaaatggtcgatagcgtgccgcgatgtaaaaatcacagcggtatgatcaagaatagagactttttgctgtctgaactcttttgccgacaagctctcaactttgatgaacgggcggaaatcaattttcacaccgtacttctcagcaatatcatagtatggcgacttttcagaagtcggcttcggctgagatacgaggactttttttattttcaatgtactaaaaatttaaaatcaaaatgttgttcgctaagataatccctttccacagaacaaaatcagggagtatttcaagggcacaaaagtacagaattaaatggaaagcgccataaaatttgttgaaaaagttactaaagcacttataaaacagcagaattttagcaattattataacaaaaccgataaaataaggagcaatttgcggtgacagatcgaaatacacaatcaaaagtacaattggaaaaagtaaaaatccggccccgattacaacattaaagtaagattccagccaaataatattgcgtgttttgttaaagaaaatccaatttacaaagctataaagaagccatttgatgacaaagaaaaaaactacataaccaatgtaaatacttagcaataaacaatgaggaaccgtacgaaaaaggagcaggtcatggtccgaaaaataatcgtacacacaaaaaccggataatatacaggtctgcaatatcagcaccaatgtataacgcacatcagatgcggtagtatcatcaaacaaactggcacgctctttagacaaagcaaaattcttaaattgctgttcaagatgtttcttgccatgtgccagcacgtatgataccaggataaagcaaagaaacagcacgcaggtcaccatccagtccgaacgcagctgatagggcaactccattcctctcatcccgtcttccttggacatatgacacacgctgtgtgtcaaagccgtatcaacacggctctgctcttccgtataaagttggagaatatacgctattccgggatgacaggtttcactcatatcgctgcaaatttacgtatttccttgttccaaacaggcgttgtatagagcaaatttatcgcttcttcggctgttgaagccaccttccagatcgcaacatgctctttacgcataaaattaccctccaccgccctttgcagcatttcaagcaaaggattataaaacccgttgatattcaagatgattatcggattaagataaagccccagctgcttccaggtgatgatttcaagcaattcctccaatgtgccgcaacctccgggcaatgcaatgacaccatcggacaaatcggccatcatccgtttacgctcgtgcatggtttccgtctcaatcaatcgggtcagccctgtatggtgccacccctgctccaccataaaatgagggattacccccgtcaccgtaccgcctgcagccaatgctgcatcggaggtagccgccatcaggccgatacagcctgccccgttaatcagattgatcttcttttcagccagaagacgtcctaattcttccgctacatcaaaatacaccttcgctatctttgtgctggacgcactatatacacatacattctttatatcattcatataattccttatgttttcgggcggatccaatcctcccctgccagccaatgacgctcattgccgcaggaacgaattgaattcgcccgtatacatcaccatattcgaatccgtttcttacaaaccgaacgcttcctttatcttatccacataatccagcttctcccaagtgaacagttccacttccagcgtctttgcttcatgatacatggattcgtatgtcttggtcaccactttcggctcacgtcccatgtgaccgtaagaagctgtttcctcataaataggattacgcagtttcaaacgctcttcaatggctttcggacgcagatcgaacagttcgtctattttcttagcaatctctccgtcgctcagtttcacattgctgcgaccgtacgtatttacgtagatattgataggacgggccacgccaatggcgtatgacacctgcaccaacatttcatcggcaacaccggcagcaaccatattctttgcgatatggcgtgctgcataagcagcactgcggtctaccttactggggtcctttcctgagaacgccccaccaccgtgagcaccttttccaccgtatgtatccacaataatcttacggcctgtcaaaccggtatctccatgaggaccgccgatcacaaacttacctgtagggttcacatgataaactatccggtcattgaacaaagccaatacttcttcattatgaatttcggcaatgacacgtggcatcaggatttcaatcacatcctgacgaatcttagccaacatctcttcgtcagccttcaactgagcttctttggaagaatcagccggagttacaaactcgtcatgctgggtagaaaccacaatcgtatcaatgcgtaccggtttgccgttatcatcgtattcaatagtaacctggctcttggcgtcgggacggagataagtcatcactttcccttcacgacggatttcggccagtaccatcaacagtttatgtgccaggtccagtgacagcggcatatagttttccgtttcattggtagcataaccaaacatcattccctggtcgcccgcaccctggttcatagggtcctcgcgttccacgccacggttgatatccgcactttgttcgtgaatggcagaaaatacgccgcaggagtttccttcgaacatatattcgcttttggtataaccgatacggttaatcacttcacgtgcaatgcgctgcaaatctacatacgccttggttttcacttctccagccagcactacctgcccggtagtcaccagggtttcgcaagctactttcgaactggggtcaaacgccaacagtttatcaagcacagcgtccgatatttgatcggccactttgtcggggtgtccttcagacaccgattcggatgtgaataaatatcccattctaaattgaaaattaagaattaaaaattaaaagttaattcgttaaccaccttgggaagttatcagagtagataaatgtaaataagaaagtcaatgtattttttagcatttttttctgtggttgcaagctactcaaatctctccactgtttttaacggctgcaaagataagcattattccttaaccattctataaattcccggttctttaacattggaatagcaattatttagaagaaattaaacctaatctgaccgatttccgttaattttgcatcatgagcaaagaaaagaccgcatttatacctaaacaatatttcgcagtggtagccgtactgctggctatcatgatgtccgtactggacggaaccattatgaatatcgcattacccacgctggcacacgatttcaatgtcaccccttccaatgccatctggattgtcaatgcctatcaactggtgattaccatgaccttgctatcatttgcctcattaggtgatatttacggttacagacggatatttctgaccggcatctccatttttgcaggcgcctctttggcctgcgccctctcggactctttctggatgctgactgtctcccgtatcattcaaggtttcggggcggcctgtgtaatgagtgtcaataccgcccttatccgtttaatttacccgccgcagatactagggcgcggaatgggcgtaaatgccatggtggtagctgtttcggccgccgcaggtccatccattgcaggcagtatcttagcattgggaagctggcactggctttttgtaatcaacattcctttgggattggctgcattagtgatcggacatcggttcttaccgcataatccggcttcagacacaaaacacaagtttgataaaatcagtgcaatagccaacgcactgaccttcgggttgttaatttataccttggaaggttttgcacacgccgaaaacagaaagttcattgccatccagttggttttgttaatcataatcggcacttatttcatccgccgccaactgaaggaaacgacccctatcctacctgtggacttactgaagattcctattttcgctctttctatcggtacttccatcacctcattcaccgcccagatgctggctatggtttccttaccgttttttatgcagaatatattgggatacagcgccgtacagatcggtttgctacttaccccctggccattggctaccatcctgaccgcaccacttgcaggcagactggtagagaaagtacatcccggattgctgggaggcatcggcatggccatcttcgctaccggcctattcacactctatttgcttcccccccatccggcagaatggaatatcatctggcgaatggcactctgtggtatgggcttcgggctgttccagacgcccaataatgtaaccattgtttcttccgctcccactcacagaagcggtggagccagcggtatgctaggtacggcgcgtctgttaggtcagactttgggaaccacactggttgctttgttgttccgtatgttcgccgaaggacatcgggcgcaggcttgtttgttattagccatattctttgccattgccgcaggcgtggtaagcagtatccgtatgacacaggcttctccggcaggaaagaaataaagccccggcaagttgttgaacagaaacatttcctttctgataaaaactttctcttgttttttatctttgagggcaaagaaaaaaagaatgaatttatctatctttggagagaatttaaacaatcaaaacctgatgaatatatgaaaaagacattgctcttactttttacccttcttttagccctgtcggcacaatcacaaaattcgttacggctaatgacctataacattaaaaatgcaaacggaatggatgatgtatgcgacttccaacgcatagccgatgtaatcaatcatatccaccccgaagtggtagccttgcaggaactggacagcatgacccaccgcagcggacaaaaatacgtactgggcgagatagccggacgtacgcaaatgcacgcttactttgcccctgccattgattacgacggaggaaaatatggtatcggacttctcaccaaagaaattcccgtcagcctgaaaaccatgacacttcccggacgggaagaagcacgtgcgctgattatggcagagttcgacaactacatttattgttgcacccatctgtctctcaccgaagaagaccgcatggcctcactggagcttataaaagactttgccgccgctcacaaaaaaccttttttcctggccggcgacctgaatgccgaacccgaatccgcattcataaaatacttgcaacaggattttcagatactttctgacgtaaaccagcatacatttccggctcccgcccctacagaaaccattgattatattacagcactgaaacagaacatgaaaggcttcacagtaacctccgcacaggtagtaaatgaaccggtagcatcagatcaccgtcctttagtaatagtgcttgaacaaaaataagcccaacagaaaatatgaaaataaataaaagagagaacatcggatggatagacttgctacgcgtcaccgcctgttttttagttgtattcgcccattgctgtgacccttttgtggcacgttttgacacagaccgtcctacttttctgcaagggtgcgcattgggaagtgccgtacgctgttgcgtgcccttgtttgtgatgatgacaggagtgctgctgtttcctgtacgaaacggcatgagtgaattttacaaaaagcggatcggccgcattgttgtcccgcttatcttctggtcggtcatgctgcctgtattgtatttcatttatctgaattacatcaccacgacagacaatcctaccatagacatgtccgccttcaccctggaaatgactatcacgaagatttggacattcattttcaatttcaactatgacaccactcctctgtggtatctgtatatgctggtggggctctacttcatcatccccatcttccatgcatggctggagcgtgctacccggaaagatatcaagctatttctttccatctggggcatctccttgttccttccctacataaagatggccgctcccgcactgggatatatcggcaactggggcaatatggatatcctgggagtgtgcgactggaatgcattcggttcattttattatgtttccggatttatcggctatctgatactggcccattatctggtaaaatacccgctgcaatggagttggagaaaaaccctggctatcggtatccctatgtttgtgacagggtacgccatcactttcggcggctacctcatcatgcaggaatattttccgggaaactacgcctatctggaaatagtatggcttttcggcggcatcaatgtatttatgatgacatttcctgtttttgtctgtatacagaagcttaaaataccttcttcgcctgttctttcaaaagtggcatccatgaccttcggcatttatctgtgtcatttcgtcttcgtgcaaatgggatatgacttgttcgcctcgctgttgcctcaggggattcctgccataatacacattatttgcatggccgtaacagcctttctcatcagctacctggtggtcagagggatgtatgcatgcaaatggaccagaagatttgtggcgtaaaaacaacggattcaaaacacaaggagttacagtatcctgttggctgattatttccttcaaattcttcatttacttattaagtgttgataaccaattatttaccatgattgatttattcataaattcttcatcattttgtcataggatatttcaatagaaagcacaacattacaactgttataaatggcgcaaacaaaatgaattccgttcctgtaacttgagtgattccaccggtattttctcccaatctctgccttttcatttaatcgtttcaccttagtgatgaacttttatcactaaggtaatcaagcttcatcactaaagtgatacagtttcttcactttagtgataaaacttgatgaaaaggcagaagaacaaaatacaacagacagatttcactgacaagacaaagagctttcatgctttcccacctcacttccaaaggagaagccacggaaagcataaaaaactgacttttccctctatcagatacaagttgcccggatttatgactatatttgcaaaatctgaacacattcttatgaaagctttacttttgacaggactactattcattctcatcctccccggatgcagaaaagagacaagcatacttccgctattacgatctgtagaggaactgattcccatgtatgccgatagtgcttccgtgctactggacagcatacaagcccccgatgaactgactgataaggactttgcccactggtgtatgctatgcggtaaagtaacggacgaagcagccaccggattactccctatctaccaatggcaacgggcacaacaatggttcaccgaacacggcacggcagaagaacaggcgcaaatagacttgtatctgggccgtgcttatgtagaagatggggagtatgataaagcaatgcaaatatatgccgatgcactgcaactggccaaagaacatcaggcctataatgtggcagggtatatttgtgcctatatggcagatttgtatggttttagagatataaccagtgaacgtctggagaaaagaaaagaggccagtaacttcttcaagaaagcaaggaactacaaaagctatgcatacgccttaaaagatttagcgtgtgaatgtacactcactgattcttttaattacaccatacccttacttcaaaaggctgattccatctcacaactactgcataacaaagatttaacagctgatgtagccaatgcttttggagtgatatatgaggcacaagaaaaatacaagaatgccgaaagatatttcttaaaagccattgaaacgggcagcaaagaaagctataaggattctatctccctattacacatatatataaaagacaaccaactggcaaaagcacacgaatggattgaaacgataaccaaacacaatgatatcgcttattacttcaatcaagcttactacctgctttataaggcagaaggaaaatacaaggaagcactccattacaaagaaatctgttccgacatgctcgattcactgacattagttcaaaatgagacaaaagtattggaaatagaaaaaaagtataacaacgccaagatacgggaagagaacgaactattaaagattacacagcaaaggaatacaatcatcatcattattgccatctccttattcttactatcagttgcaggatatatcatttaccggcagagaagcaaagccaaaatctattaccagcaaacaattctagataagatgaaaatagagctccttcacttatctgcagaactagaagaaaaaaagcagattttgcaaaaagcattggcagacaaagagaataatgcccacaaactacaacaggaaatagaagtaatatcctataaatacgaccggctgcaaaagcaaagtctggaaacatccacagttggcaagaagcttatttctttgactaaaaaaaataggcttgaggactcccaactccctactgacaaaacatggcattccataatgacggaagtagacaagatatatccccaattctactccctactaaaagaggcatttcccaacctgacagaatcagaatatcaatattgctatctccatatctttggatttgacgcaaatgatgaagccaaattgctcggcatcaatccggcttctgtacgaatgaaacgaacgagaatttatcaagaggtccaactaaagcacaataaagaaacgtttttacgagattacatcatcaaaaacctcttaaaataaatagttctcatacagatcttattatcagtgaattataaaacactacatatacatcactgtatataacaatttttgtaactcgctgataatcaacaaatcttgtatatactataactccctctttttgtcattcataatcctataatacctaagtttgcacaaaactaaaacgtaaaacgattatgaacaaattaaaaatgagtttggctttgatagccttaattattcctctattactatgcgctaaaaaacgaaatatagaatttataaaacatggcaaccatagaattccagtagagtcattcattccggtaaaagctttctttgacgactgcaataaagaattaaccatcgaattcgcacaggactgggaagcggtaaccatcgagattaaatcaaaagaaggatatgtagtatatagaaacctctatataccccactccaattcttctttatcaacttctttagagaatattccggcaggaatatatgaactgacaatcaccgatgaaaagggaatattggcaggagaatttatatacgaaaactaatctcatacataatattctaataacaaacttatgaaaatcattccattatcactattctttgcaggaattacattattctcctgctcgaatgaaagcaccaataacctttctactaattcccaaaaggttaagttgaataaaaacgaagtcctcagtatcgcctacgatgatgcaaaagagcttacagacaaagatattttcaatatggtaagttcttttgccaatatgaataataatggtgtaagcagaagcactagtgcatcatttaagattacaaaaagaacatatataaataaagaaggagaatttcaaaataaagaaatagcttcccgaaccgccttaccagaagatgatatcatatctgaaatttgtgaagttgaatttcaaaacgatactgtaaatgggttggctgtagtagctacaaatgcagaacttccttctattatagcatttattcccaataaaggcaatgatgatgcaatgcaactgagcggagcaaacgaactattatatgcagcaaaagccagctatctttataaagccattaaaacaaaagaattggtagattcgctaaaacagccaacgttggagaaaattagtaagaaattaaacattcctatcaatgaaattaactaccaaaaaattcaagataatatcattttaacagatacctattcatctagatcaactgctgtacaaggtcctcccgagggaatacaaaaactaccatcatcaatatctcctctagtcaagaccaattggggacaagacgatccctataattgggctttcagagaagaaaataaagtagattggataagaactgaaaataatggaaagaaaatggacgcacttcctgtaggatgtgtcaatgtagcacttgctcaaataatgggatatactcatcaaaaatatactccccctcttacctttactttacccaacagtactatgacttatatgcctaactttattaaaatgacccaaaaagcctctatcaatgatttacaggggcaagctcaaatgcaagttcaataccttatgctcaacttctataatatgaataaaactacatccaaaaaagattgggatggtgctgtacttgaaagtggtgtttctgaagagaatatgctaaatacgatgaacaaattttttaaatataatccaaaagccccttttgatggtgatcaagtttgggcctcattaagaaataacaatccggtgcttatgctaactacgaaccatgcttttatcatttccggacttctaatcaccgaaaaagctagtcaaactcgccaaatggttaagacgaatgatttatattggcacgcaaatttggggtgggctgataaaaacacagggtattatcaactagacggaaacgcaagaaccttttttgaagcaggaggcgtaaaggaatggtgttataaaatggattgcataaaaaatatccgtgctaagtaaaaatataggtttacagaactaacaataagaaacaagatgaaaaagaaaatcattttctgtttattatccctttcattgatgattgccggatgccaatcaaatgaaatagaggatataacaccccctagtaaggaagtacaactatcaccagaagagctattaagcatcagatacaaaagttctccggaacttagccaaactgaggtattcaatttattgacaaccttccaaagcagtgaactaaaaaataatgcccattcacgtattacttttcagcctaacatctttcagataaaagagaaatactatttatctaaaaacaaagcagatgccaggaatattgaaagtacagaggaacaaatacctatctataaaatagaattcacatcagaaacaggcacaggaatggctgttgtttcgggagatagaagagccccacacatccttgcatatatagacaacatcaaggaaaaccaggattctctttacacaagtcccaacgctttgcttcaatggagcgaaatgtacatccgcaatgaagttaccaaatttgatgatacttaagttttgcgataagaaaacaaaatcataacaagtgaaaataaggcaatcaaaagaagcgtaatatattggtattcaattataattgattgtactttttgattcctttggcgaaacataaatttccataaattccttatatttgttgcgtatttgttacgtgaaacaaatcatttgtcgtacctttgcagaagagaaacaataccgctgacagacggcaaaagcaaattgaatgatttatgggaagaccgaagaagacaaccaaggcgaaagagccagtgcgcatccgggaacgcaagctcgcaaacggcaacagaagcctctatcttgacatctattcaaaaggtgtgcgcaaggtggaatcgctcggcgtgtaccttgtcccggagaacacgcctcttgacaagatgcagaacgagcacgcgagaagcgttgccgagaagataaagtcggagcgcatcatcgcgttgcagaactacggcatagccaaccttgacaaggtgatgaaagcctcgatgccccttcttgcgtatcttgagaaatacgccagtgaggggaacggcctgaccgaatcgaccatgaagggacgtaaattcatgcggcgcaaggtggaggaataccagcggtcaaccggacggcttaacatagccatgctggaggtcgatttggatttctgccgtggtttcatcaatttcctccgcactgcgaagaacaggcggttgaaaagcgaagaaaggacgataagcaactgtacgggactacagacacaggccgtgtttacagccgcattgaacacggcactacgtgacggtatcatcgaacgcaaccccatgaccttgctgacatccaaggaacgcttccaccagcaggaaagcacgagggtctatctcaccattgatgaattgaaaagaatgatggccactccctgcgatgacggggaactgaaaaaggcattcctgttcgcctgttttacaggtctgcgtctcagcgacatccgcacgttcacatggaacaaggtgcttacaacgccaaacgattccacccgttatataagggtcaggatgctcaagacgcaacaggtcgtcaatgtgccgctttcaaaggatgccctcggctatctccgtgagacggaagacggggacgagccaatcttccgcctgtcaagcgcggcttccgtcatagagcaaaggctggcggaatgggcgaagaaagccgggatagagaagcacgtgacctttcacgtcagccggcacagctacgcgacgatgatgctgaccataggagttgacatctacacggtgagcaagctgctcggccacaagaacgtggcgaccacacagatatacgcgaaaataatcgaccagaagaagattgatgccgtcaacatgatggacaggttcttcggcaaagacaggcaggcatgaaaatagaaataaggacacgcgagctgaagaacggcaacaggacaatataccttgattattatgacaagggcaagaggtggtatgaatatcccaaactgtaccttgtccctgattccgctccacatgcaaaggatttgaataaaaatgcgatggacaaggcaattgccatcagagccagacgactgctcggcgagacaccggaagaggacggcagcccgttgaaggaggccgacaagattcttgtgagcgcatggatggatgaatacgccaaagccatgcacgcgaacgcaggactttcccttacctatctaaaacacttcgacacccttatccgcatggtgaacggctatctcgcacacatcaaaagcccgcgtctcacgatggactgcataggccgggagttctacaggggattcctgcactacatggccgatgtctataagtgccggacttctgatggcgggacaaggcggctggcaaaatcgaccatgcacttgttccagttgaagatgaacacgatgctcaaccaggcggcaagggagggtgtcatcaagtgcaatccttatcacctgctgtcaagggacgagcggataaagaagccgaccgaccaacgtgatttcctgacccgtgaggaactgcacaggctgatggaggtggagacacgaagcaccacaaccaagatggcattcctgttcagctgtttcacaggtttgcgctacagcgacctgaagcaattgaagtggggcaacatcgagaagtcacagtccggaatggtgataaggatagaggcgatgaaaaagacggaaaaacctgtgaccgtccctttgggcacgaacgcgatggcatggctgcctgagcgtggcgacaagacacttgacgattttgtctttgatttaggcacatgcggaggttgcaacgccgtcctgaagaatatggcgaaaagagccggaatcaacaaacgggtctccttccataccgggaggcacagcttcgcgacgctgacccttgccgccacgaatgacatagctacggtaagccgactgcttgggcacacctctgtcgcaacgacacagatttatgcggaggtgctgatggaagacaagatagccgccgtaaataaactgaatggcatattttaattcgataagacccttttatgaaacgaatctccgataatttccttacgatgcttttgccgcttactgtagtagccgcaaccgcattcagtctggttgccgccgtcgctttccgcatgggagcgaccacggcgggatttgtatttgccaccctgtccattgtcgggtggataggactgtttgccgagtttttcctcttgtacgacatcatcatagacaagtggctttccaaagaccgttctgtcctgaccgcctcatggtttgtcatatcgctgctgcttgcctttattcttactcccgacaaacatacggattggagcacttgcataatcatggcctcgctcttcgcagtggttttccttttgccctgcatcatcgggatggcatacggcaaacagataaaatcatggatgctgcaacggtggaacagccttgttccaaagaaacaacaacacacggatgaaccgattgaaaagcaaatcgaagccttgctttcagcatccacgccgcctgtcacaatgaagcaggaggatgaaatcaggcactacgacagccttgtctcaaaggtgcagccggaacagataaggagactgcccgaatcattgcagaccaatgatgccttgtttttgttggtactgttccgtgaggacggttatcttgacacggacttccaaccgctgatgaaaaaggaagatgacgaaatcaaccaaacgctctatgcctatatcgccagtgccctttgcgcagccctaaaaatcaggaaaggcaaatgggtcatcttcgagaagttctggccgctcaacaacggcgcacagctggcaagcaacttcaagaccgcctacagggacaacccgtccgaacaccagaggcatatcgccaaactgctgcgcaaggcgacccgccttcgtccgaaactcgacacctacgacctcgaagagttcaagaaggtctgacctgcatcatccgtacaatcctcttccttgttcccgtcaccgtaacccgatggcgggattttttatgcccgtccgagaacaggcctgtttctttccgcgcttataagttaccatgtacggattatcagggattatggagggtttatagttcccttatacttcgtttctgctccatttatagttgcatttataatccgcaatgttctctgtttgtgtcatttatagtaattgtttcgggataattacgccatacctttgcactgtcgccacgacaaaggcgaagcatattattcactaaaatatacgcacatgacagagcaaagaaaacttttaagtaccagggaggcggccgagtattgcggcttcaaactttcctatttccgcaagctgatgatgcgccgggctatcccgatgtacaagccgacgggcaaactgtgcttcttcaagaaggaggatctggacgctttcctcacgggtgtccgtatctcctcacaggaagaaatcgcggaggaagccggccgctatctggcaggacggaagtaagcaacctttttattcacatcaaaaaacaaatgcagtatggaacagaacaggaacatggaacagggcggcacagccgcagccgttccggcagagaagaagaacgagaaccgtaaacgcgaggtgagcggcaaggacgcacaaatcatccgcgcattcttggagagcgtaggcatttacgaggcggacgccttgcgcgtgagcatcgccatcgccgacggcaaggtgtcggcagacaacatttcagcggatgaccgtcttgcgctcaaccgctatctcaacagcagtacggacaacgaccgtctgacggcggacaacgcacagggacatcggctgaaccgtgcgttcgggttgctggaacgtgtggcggagttctgcgataagcagcaactggtgacggtaaacagggctttgctttccatcgctgtaaatgcggaggacatcagccatgccgtatcaaaccttgccaaacgtccggcatccgtctaaccgtccccaaggaaaaactggcgcaaacggaataggagagtaaccacgcaaaagatagaaaggtgtttggccgacattcaaatgaccattttatttcttccctacttttggatcagacaattcagagggcatcttgaatgacagttactcctttctcatccgataacacgattacaggaaaatgaagccgcgcagggaacaacaagaaagcagattggtacttccataccgactcctgcacggttttattcctttcaaaagacagaaatatcacacttataaaaacaaaattagatgaacaaggaaacatacagattcatgtacccggcaggtatcgcatcgctgtcatcggtcttttctcagaaagcattgcaatggctgttcagcacaacgactgatgatgacggctgggaaacaggcaacttcatattgtttggcgacctgttggcgagaatggcacttactgccggagagggcaagggcttccgcagaccgctcacgcttgccgcaggacaggcgcagtattccgaggaacagctttccacgcaatggaacatgggcaggaagcgcatacgcaacctgctggacgcactcacggacatggggcttatcgacacttgccgttcaagggtggcatccgtgatgaccttcccgtgcgtccgtgaatggagaacatctgacggaggttgcataaccaatccatttacccatgaacagagggaagagtaatagccgaatgacagccgggaaaacagccgagccaatactgacagggctaaaaccgcctttcctgttgttcctcagtccggcaacaagcggcatccgtcccgtgcaggaagtggcagacgcacgggtggagtggaatggagcgatagcgttgagttacgagatatgccgaggtatcaccgccttcggacggtattaccacgacgctctcgcaacttcccgaaaggtcgttgtcccagccgctcgcaggctcgcaccttcccttttttagacaccgtttcacgattattttatatatggaacacgaagatactttagtacaggagaatcaggaatccgggcaggaaaagcctgttataaggcgtgacaaggtggtagtcaccaaggtcacggagcaggaactttcacagattaaaagcaccgccgggcagtacggcatgacacgcagcgacttcatccgggcaagggcactcaattacagacccagacagcggctttcggttgcggaggtggacggtctgcggcagcttgcggcttgcaggacggacatggtgaacttcgccaacgccctgcacgggctgaaagacgatgagaaaatacgacttttccggcaccagcccaccatgctcgaatggtacgagaaagtggcgcaagtgacagaccatgttaccgacttcctgcagtccgcacagaaggcgaacagttacccggcagggacaacggacgaagagactgaggaggatgccgtatgatagccaaggctaaatccattagtcacggtatcagggcgatactgtatgtgtcgggcgaatcgaggaacaagaaacatccagaaaagataacgcgcatctgcgacaacttcatgccgcagggcatggacgcttcgggcatttggacggaaatgaagttcgccaccatggaccgcccggacatcaagaacaacgtcatacgcttggagataagtccggcgatggagcataccggagattttacggtcaaggactggcagcagctgtggaacgacttcgcggcggctttcgacaatcaggaaattctgaatgaggacggcgaggtcatttccgtaccgaccaacatatcgggcagcaagtccagcgtgtggctgcacagggaagccaagagcggcatacctcacctccatgccgtcgtctgccggatagacgagaacggaaacatcaacaacgaccacgccatccacatccgcgcacatcgggcggcggaaaaaattgccctgcaaagggaatggataactgccaaacacatacatgaaagccgtattccgcaagtcagcaaggactgcatggaggttttgcgtgaactggatgaatggtcttgggagggctatgcggagaaacttgccgccaaaggctacgagctgtatctgcgcaaggatgaagagcaggtgatacgcggctatgtgcttcataagggcagttcaaggttcaagggctcggaacttggaaagggacgcaacctgaccgcttcccgtatcgggcggacttgggagaaactgcatcccgaacaggctgaacaggaaagtccggcaccgaagcagcctgttgtaacgacagtgaagccgcctgttcataatgaagccggacaaaagacacagaccaatgccggacggaataatccggtttatgaaagctacacggagtggcaatccgaccgcctgcgcacggagttcgagcatgacggaaagaactacgaccgctatattcccgaaaaggtgcttgactgcctgaatgacgagttcgatttccgggaagtggccaactggcagcccttgcagaatctggcgattgccttttttacgcttgtcgcttctccttacgggaaggtcaccggcggtggtggaggcggctcgcagtccgacctcaaatgggggcgtgacccggaagaggacgagatagagttcatgcgccgttgtgcgcgggaggcttcgcacaggcttggcagacaaatgaaatcaggaatgaaacgtaaatgacaaaccaataaacatcagtgataatgagacaacccgatacgtccgctctacgggagcggcttgccaattatacacccggacaggaactgaacgaggacaagcaggaacttgaaggactgctactgaaagtgaactgccagattaccgaattgcgcaatctgctcaaggaaatcaatgcggtaaaggaagaactggaaaaggtaaaccaatgctctgtcagccacatcaaggcggaagaagcacggcggcaaagacttgaacaacggaacgatgcacttgccaacgagttccgcagtctcaagccggagattgcggatgcgcataaaaacttggaaaaccttatcacgaaacttgaagccttctcaggtacaatgataaatctccatgacctgcttaaggcttcatttcctataaggtttgcagaaaacgacagacaagcattgctggaggaaatcaatggcattgccggcaatgccatatcacggattcacagagaacgcgaaaaagcagacaaggaaatccaccgcaatgagaaccgcatatccatgacacagacgacattctggtgcatgatagtattgctgctgatacttgccatattttttgccctcgtcatattcgccaacttgaagttgtttcattccgagacgctgaccggaatgattgccatattctctgtattggttaccgtcaccctcgttgttgtctcccttatcttttacaagtactcacattaaacaataatagatatggcaacagtaaaagtgaaattccgcccgtcaacagtcgcagaccgtccgggcagcataatcatcattgtaactaaccatcgtgtagtaaggcaaatcacgaccggctacaaagtgtttccctgcgaatgggacgaaaagcagtcccagcttgtctccactgtcgagaatggccgtatggctgccatcaaatcaattacacaaaggctgtgttgggacgtggagagattgcatggaatcatcgagagactcgacagccggcaacgcggctattctaccgacgatgtcgtctcggagttccaacgtaccggcaaggagaataccttctttatttttatggagaatgtcattgtcaggttaaggcaactgggacacaccggcaccgccaacaattaccgcgcagcattggggagtttcaagcggttccgggcccacgaggatattccgatcggggcaatagaccatgtcgtcatggaggattaccaggcgtacctgaacgctgccgggctcgcgcccaattccacatccttttacatgcgtattctccgggcggtctataaccgtgcggtcgaacaggaaccggccatcgaccgcaaacctttccggaccgtgtttaccggaacggagaaaacacgcaaacgggctatttcaatcggcgacatcaggcggattaaagaccttgacctctcgcacaggccgaaccttgaatttgcccgtgacgtgttcctttttcttttcctgtgcagggggatgtcattcatagacgccgctttcttgagaaagtcggatattcagaacggggtactgacataccggcgtcacaagaccggccagcagcttcaagtcaagatcataaggcaaattgaagaactgaccgggcgatacccgaccgacgggctgccgtatttgctcccgattataaccgttcccggcaaggacgagcgcaagcagtacgaatcagcgttacgccgcgtaaacaagtcccttaaaaccatagcggaaatggcggaactgccggttacacttacaacctatgtcacgcgccatacttgggcgaccatcgccaaatcgaagaatgtcccggtcaacgtcatttctgacgcgctcgggcatgattcggtttctaccacacaaatctatctcgcatcgatagactcgtctgtcatagacaatgccaatgaactggttgtgagtgaattataacaggataagctgtgagacaaaaacatccgtctcttcctaagaaacggattccgaatgcaaaagtaaataaaaatcctaaatatcaaactattggaacgaaaatattcaaaggattacacataaaaaataatattccgtaaaacaaaccaagagtaagctgattacttataaacctgattattaagcaattatattttacatccgtttcttaggaagaaacggacttaaagtaaagataatatgcacatgagaggtttaatagtatcagcgttcatgttgctcggatgcatccagatgttcgggcaagagagccggaaggaggtctgcatcggatttccggtcggcaactcgacactggacacggcttatggtgacaacgccatgcgcctgtccgaagtggtgtcgtttctggaaagtgtgaaaaaagacagcacgctcgaactggtcgaggtgtctttctgcggttccgcctcacccgagggcggctttgccataaacaaggaattggcggaaaaacgccgcaattcgctggagcgttatgtacgtgaacgcgtatcgcttccggatagtatcatttcacgtcccgaaggatttatcgcgtgggaacgtctcgcggagctggtcgaggtgtccgacatgccccacaaggaagaggcggtggacgtgatgcgcaacgtgcccgaatttacctatgacaataaaggtgtactggttgacagccgcaagaaacacctgatggagttgcaatatggccgtacctggcattacatgcacaagcatttctttgaccaaatccgcaatgccagtgtcattctcgtgacagtccgtcaaaaaccggtaatcgaggaaaaatcggttgtcaaggaagagccggtcgtgccggttcctacagacacgacatccgttgtggagaaaacggacacgggcgtggtggtttcccctgaaacctcaaaacctttctacatggctctcaagaccaacatgctctacgatgtgctggccgttcccaacatcggggtggaattttacttaggcaagaactggtcaatcagtggcaactggatgtacggctggtggaaaaagaacagcagccaccgttactggcgcatatacggaggtgacatcgccgtgcgctactggttcgggaagaaggccagtgaaaagccgctcacgggacatcacgtgggtgtttacgggcaggcgttcacttacgacttcgagtggggaggcaaaggttacatgggcggagaacccggcggaacgctttgggacaagacgaattacgcggcaggcgtggaatacggttactcgctgcccgtcgcaaaccgcctgaacatcgacttcacgcttggcgtgggctactggggaggaaaatactacacgtacacccccttggacggccactatgtatggcaggccactaaaaaccggcactggttcggtcccacgaaggcggaaatctctctggtatggcttctcggaagaggcaacagcaacaataagaaaggaggcgtgaaatgagaaagatacacattataacagaatatgtccccttgttcgcgggaatgctcatgctgctttcatcttgcgagcacaaggacttgtgctttgaccatgacccgcatgccccgaaatcggaggtgcgcatagaagcggaatacgaaaaggagtggcaatatacctatgaaggcagtacggattggaaaaacttccccacttggcaggaatcgttcggtatggaatacgacgcgttgcgtcccggaataccggatggcttgcgtatgcaggtgtacaacgcggacgactcggatgagatcgtcaacatcgcccccgagggggaggtcgtgtatatgcggccgggggaacactccctgctgttctacaacaacgacacggaatacatcgtgttcgacgagatgcagtcgttcgcttcggcaaaggccaccacacgaacccgtacccgttcctcttatctcggtaattcttatatggacacgaaaaacgagaacacggtgaaccagcccgatatgctttacggcagttacatggagtcatacgtggcggaacgctcgaccgagaccgatgtgatacctgtcaccatgcacccgctggtgttcacctatctggtgcgttacgagttcagccacggggtggaatacgtgtcgctggcacgcggtgccttggcgggcatggcgcaggcggtatggttgaacagcgggcgcacgtcagatgaagccgcaaccgtactgtacgattgtacagtggaagatttcggcacacaggctttggtgcgttctttcggaatacctgatttccctaacgaacactacgggacaagggccggacgtaagtacgggctgaatctggaagtacgtttgaagaacggaaaaatcaagtcgttcgatttcgacgtgaccgaccaggtggcggcgcaaccgcagggaggtgtcatcgtggtgaagggcatcgagatatccgatgaagagggtacggaaggcggctccggcttcgacgtggacgtggatgactggggagattacgaggacatagaacttcctctttgatttgcatagagagttatcaaaacatttttattcacaatttaatttttaatcaaatgaaaaaaatctttttgattggattggcagcaacagccatgttggcaagctgcagcaacgacgagaccgtggaaatggcacagcagaaggccatcggtttcagcaacgcgttcgtgaacaacggaacacgcagtatcgtggacccgagtttcacaacaacttctttggaagactttgccgtatatggtttcacacagaacggtcagatcttcaagggtgacaaggtgcataaaggaggttctgcctctaccggatggtcatacgatgcattgcagtactgggttcctggcaacacttacactttcggtgccattgcgccttacagtgtagcgacaaatgtttccaatgtagcattgcctgaaaatgccacaaaggtagaaatgacggttgctttcaccaacactgatgcggatcaggttgacttgcttcacgcagctcccacgcaaattgccggaacagaggtaacagagacatacaaaactcctgttcccatgacattcagccaccagctttcaaaagtgaaattctcgttcaagaatgcagtgggtaagggttacaacgtaaaagtaagcaatgtgaaaatcacggatgcttacacaaacggtactctgacagtagccgttgccggtaacacttggagtaatcaggcaagcaacacacttgaattggatttcggtaatgtagtagccgatgatgctaccgctgatgaagctgccttcattgccaacgatgcaactcttgaaagctacaacgaaatgctgatgattccgactgacaacacagcagaatacactgtgactttcgatgcttatctgtatcaaggtgacgtacttttgaataaagatggggtggcatacagtcacaccacgactatcaagggtgttgaactcaagctcggttattgctatgatttcaaggccactctgacacatgaaaacatcgtggatccggagaatccgttgaagcctatcaagtttacagttgacggtgttgaagactggaatcaggacgaagttgagcaaacattggacgttcccacaacccaaagcggcaactaatccaacatctttcataagaccggtttagcatcgtgtattccggaattatcatccatggaatagatgatctacctacagggtgtaaggggttgaatgtcctcttacactcactaacagccggggcgtattgcttcaggcaaacaaatataaaacagaagaaatgaaggtacataagaaaaatccgagttggatggcgggcggcatggcgacgatgttgctgtgcacgctacttttctcgtgcaataacgaggactttctcgaaagcgggaatccggagaaagcctgtgacaacatttgttttggcatatcgtccgataagaacgtgcagacaaggggatatgccggtagtgatgacgaaggatataccgcagaccgtttcgtgttgcggtcggacgactcggcagacacgctttgtgtccgtgccattgtttcggaaggcatcaacgtgtccggcttcgagggcgaacaggccttgacacgcggaacgcctgttggcaaagacaatttctatgacaagttccatgtgctggcatactggagtaagaatgggatgtccgttgacaaccagttctatatggatgagaatgccactaataatggttcagtttggagcacggaacaaatatactattggccgggagcagaccattcgttccaattctatgcctgggcaccgacggatataccaaccgattatctgaccactccgtcctctccccaaaacaagcttcttgcatacaccgttcccaaagccgctgccgaccagaaagacatcgtggtggctactaccaatgaaatacaaggcgacaacaatgaggctgtgcctctcaccttcaaacacatctgcaccgccgtccgttttgccgtgggcagccagatgcagcccggctctatcaagagcgtggctttgaaaggtatcccaaacaccggaacttacgatatggctgccggtacatggtctcttggtgatgcgactgtggatttctcgcagaccttgaacaaagagactaccggaactgaagctaacggagacgcaattaccagcgaacaaggaaccttcatgatgcttccgcagagattgcctgcaggtgcaacggtagaagttgtatttgccaatgccaataatgaaaaacgtaccctcaccgcttccatcggaaatacggaatggacgatgggaacaaccgtgacttacaagctgtctattacgccggaatatgagctggagttttcggatatcccgacagaagtggatgctcattatgacatcatccctataaaaataaacgccaaagacgtggaaggagattggacaataacatccaatcagtcttgggtaactgttaaatccgctttgacttcatacgagaaagatggttattggctgaataccacaggtgattattctgactactgttcttcagaaggagtggctgttgaacgccagcagactttggataaatcaggtaatggtgaggtggaactatatttgttcgtttcagaaaacaactcgactatcgaccgcacagcaacgctcaccctaagcaaggatggcacagaagccgcaacaattgatgtcgttcagaaatgcccgaattggcaaggagaccttggctgggaagttctcgaagagaacttgacacttccttatggatttaaatgggatagaaaagttactttacaaaagaccttgactggtagtcggctggagaaatatattgaagagtggctaaccaaacaagcatttaaagttcaaccaactgattttttggggtggctggggtctctattatggcctacattggtagattatgtaaacattgccagaagtggtgatgtcatgacagttgtcgttgattatagtgaaatagctaatgtgacatctgcgatgtctgcaactgatggtcaggctaacacatggaatctgtattctaatgttggaggaacatccttcgaaggagaacaaaatttgattaatagtggctatgcaattgtaagtgaaagcggttcgaatgaagataccaagaactttgccgctctgtatgcggttaagttgaatgcttttgatatacataaaggaggttcagaaaaccaaataacttatgctatcataccagaacaaacagatattaaatggtatcttccggcaattaatcagttctcagatggtgctggcttgagtggtcaatactggtcatcaacggccaacaatgacaataacaatgcaaatgcttattcttggaatagttcatcgcaaagtataccaagaatggattcgcataaagttcgtgccgtccgtcaaaagccctaagattcatccttaaccaaatagtagctacaaccactaagcaagccgactatctgtaaaaaggaaagttggcttgcttgtttagtagcctaatacacaaagccaagaagttgtgaacattcccgataacagagatagtccatgcaaccgttcccggggaattcgtcctgagacggaagagaaataccgtcaggcaatcgagctgtgtcgttcgacacgattgtcttgtgcggaaatctgccgtatcagcaaagtgacggtttcgggatttcaacgctacctttcgcaatatcaccgtcccctgctactggcacgttatgacattacttgcgacaaggaggaagcctctcacatcaagttgagtcagcttcgtgggcagcttcccgctacccgggccaaatacaaagacgccatcgaagcatgtggaagtctggactatatcgaatacaatgtctcgcaaatcgcccgccggttcggactgaatggtacagaccttggcaggcagttacgcacgcattatcccggaatcatcgagtggcgcgagaaggtacgcaagcgtttaggcttaaatgacaacctgccacgcggtacgcggaaggtgtgtaaggaacagtatgccgaggcagtgaaactattacgtgctgaccgttatatcacggttcaagaggtcgccgagcgttgcaacgtctcttactcgggattggaacaacacttgatattctaccacaaggagctggtcgaaaatcgcatcaagataagggaacgggctgtaagacagcaacgcaaaggcaagataacgggacgagggacacttcatgccgctacccctgaaacaatcacgaaatacgcggaagcattgcacttataccgcaccacacccatgtcagcccgaaaaatagccaaacagaccggtgtatcaataagaggtttctacgactacctgcaaacctggcacaaggacttgatttgtaagcggaaggcatcccttacgaggaaggtaagcccgtggactggtcgtccgttcggaaatataaccctgccaccgcagccaaatacgctgacgccatagcccggctgaaagagggtggactgaccatggcaaatgtggcggaggaatttggcctgcaccccgactgtttcaggcagtacctgaaagagcatgagccggaactgcacgcaagtttgggaatgaaaaaaacggaaaacggtggaataatggcaccgcacagcatggggaaatatgccgaagccctacaactgtactctacgacgaccgaaagcataaagtcactggcgcggcggttcggattcaacgactgctccttcggccagttcatcagaagacatttccccgaactgcacgaacagcataaggaactggtacgacaaatgaaagaagcggattaagttcacactatgctgatacgttcttttgaagccaaaccggactaaagctgaatcctgttaatgagttctattgccgtaatgtcacgcatgagggtgaacccgaaccattttctgcccaaatccttgattgaagcccctatgtggtacacttcattgtctatgagcagaaaccggtcgtgtgccttgttgaaccgctttacctcgataagcggatattgggcgttgtggcggtcaacatcaagttgaaactggttgctgacacgctgcgtgtagatagtggctgataccccttcctttcttttatcaagcaaagtcagcacggtgtcatccgcgtaattgtcaatcagtacaacagactgttcagccttccggattaaatcagaaacgaaacggtaagcgtcaaacacctgcccgtcatagaagatgccctgcacaggaggaacgtcggcatccaaacgcttgaagacctcgtcgatgcgtctgtcggtcacgtcctgatgctgtttcatttccagttggtgatactctatagtctcaagccgttggaataattgggcattggtcgcaataaagcggcgcatggatatgaaagccctcattatgcggatgttcacctcgacagccgtctttgatttcaataccgaactgagcatggctattccttgttcagtgaacgcgtaaggcagttttcgggttccgccccaacttgatgtcgcattttgcgacatcaagttatcaagctcgtctttgctaagctggaacatgaaatcatcaggaaagcgttccatattacgcttcacctgttcgttcagccttcgtgtttccacaccgtacaatgcggacaaatcactgtcaagcatgacctgtcgctctcttataatccgaatcatcggctggatgttaattacttcgggcaactggtcgcaatttgcgaccggctcttttgccatgccgtttatattttccctttctttcgccatagttctgctttattgttcgctttcgtccagacctttgataatttcgatgcccaatgtgttttctattttgcaaatggtttccagtgacatgttcttttgccctttcagcatcttggagatatattgctgggtgcaattcattttttcggcaagcatccgttgcgacaagccgagttccgacattcgctttgacataaggacggcaatagcccgtgagcattgcgcccagtcccttttatcctgtcctgatttgactgtctgcgattcggtctccaaacccacgcgaggcattttgtctgtcactgtattcattgaaacgattacattgcttaattcagttgcaaaggtagcacaaatattcgaaattgcacaacttctgggttgttattccgtggaaagaaacgaaataccatacctaaatcaaagatttagggaagtagagacttgtcgcctccctattcataatggtaatgaacttccatgttgttaattcctatgttctaccgtaggaacaatatttctccatttgtttgttgcgaatttgttacacacagattgtttgcctatgtattgctattgattatcagggtattataatttatgcaaaatcaatgagattaaagattcattgtatgaatctgctgttttgaaaatatccaaagaactatacataacatccaaagacatcgattatgaagcaatcaagaatcaaattatcataaacaacagctctatcagccgctctaaacctataacagaagttccttccaatctaaaggtcaaagttgcagtatttcctatgtgtcctgtggcatggggacaatgggaaccttataattgtatgttaccaaaagccaattgtgataggtatggtccgggatggtcagaatatacaaattatcctgtaggctatggagcaattgtggtagcgcatattctagctagtttggagccaacgatgagaccagccagcctacaaataaattggagttatttgactgaaaataaagaaatcaaagcaccagattattttaactccggtgatcctttagctaaaagagaaatggtaggcaggctattcaaaaatatctatgattatacaaaatcttctgtagtcaaagactcaaaaggaattgttacggggacaacttgtttaatgtctgatgtggagaattatttggcaagttacttcaattatagcaaaaagacatcatggaatatcaatactgtcaagaattccttaaaagcaactaaacctgtattaatatacggcaaacctgacaatatagctaccgatggagtcaccccattcattcttgatggaataaaagaatgctatggtaggatagacaatgttccttccgatgtggacgtatgctatttacacgctaattttggcttcggaaacggttatcaggatggctactatttaatggatataaaaacatcgacaataacttttgaaactgccattccactaattttcaaagacaatgctatgaccataatggcagacttcagaaaaaaataattttcatatatcaaaactgactaaaagatatcaataacgcaaccttttagccagttttatcattcaatcattaacaaaaatgccatgaaaaaggttatattatcacaactcatattgataacatctattcttatatcgtgtactgataaattagaaaatacagaagttaacaacaacccaaccaaccaagtggttttgacatcgaatgaatacgccagcatagcgtatgataatcccaaagaactatcggaagacgagattacaaatgtaatttacgactttaaacgtatcaattcagaatttaaaaaacaattcattacaacaaaagaagacaagcccaagatttccattattaataaatattatcttacaaacagcaggaatcactcccgttcagcagactccattcaaataaatgtacctatatttgaagttgaactaactaataatagcggaacaaaagatatgacaattgtttgtggtgatgaaagagcaccgaaagttctgttatttacagagaactatcaattttcccaacctatgaacatagatatgagatatttggttgaaatagcaaaactaaatatcctttcagatattaaatatatagaaaaacttaaatcagagaaaagaagttccactctcgacaaaatcagccaatccctaaatatatccaaggaacaaattacagaagacatcataaaaagaaatattactattattgataacagcaattcaagagaatataatcctatcaatggcattgatataagcaaaattccttcacgaattgtatctatggtacctcccatatcagatattgtatggcatcaagaagcaccttacaacgatcaaatgcccataggaaatatatgggacgggcatatgggaacatatcaggggcattatttagtgggatgtggaaatatagcggttgctacattattcagtatactgaaaccagtcatggtgggagaaacagcagcaggtagacaaattttaatagattgggactacctgaccgctcaaaaaacaattacatactacagctcacctgatttaatcgaaatgactgccagtttgttaagagctatatacaataaaactcgctcatttcctaactatgtagattttaatacctatgacgaggacaataacccaattataaaaagaggtatcgcttcaacctcaaccccaacggaaggcatgttggaatatcttcaaacaatgactacctactcaggaagcacaggattcaatccggaactggctaaacagtcattacaaaattataatccaatacttctttatggaaacggacactatgttgacaacaatcgtctccctatcacaaaagatccatacaaagacaaaccgggtcatggttggattattgacggatactgtactaccaaaaaatcgagttcaccaaatagtgatttatattggtctgtcaacatgggatggggaaaaggttcttcggccgtctattttaaagcaaacaacggtataaactgtgatgtaatcttccacacagatacagaagacgtaaacattgtatattatacacaagaacaacaaatgatctatgacattcaaaagaaataacctcagtcaggacgtaatacacgccctgacactaacgctagtattatgtctgacactgttatcgggatgctcagacaaagaagaaatcctccctccggaaccggaagaaggaacagatattgtgagtgaatacaaagcttacgtaggccatccattcaatgcctccttgggcgaacaaacaaatggttacacaataaagaacaacgatccagaaaaactgaaaacggaatatttcggaatcgaacatttcggtgtcgtatgtatctttccactttgcgaaggagaatcatctatacatgtgctggacaagaataacaaactggtaaaaataataaaaatacaaaccaccatgtggggaagcaaggatgtggaagtggaaaacggagctcatccttatgtcaaaccggaagtacgagtagaagcacaagacacacaaaccaaacaaaatatagaaaaagaactgatgcaggaactgaaaaacagaaacggtacacgctatacattcgacaaccagacccgactatttaccatgacttttcccgatgggagaaaaggatatgaagggacctacaaatgtagagtagactcactcatcatgcaaacccaaagtataataaaaaaatatggatacgaagtgagctacaaaaacaaattcctaattatacgagaagacagaacagaagaattttgccaacgttaccctgattccggagtgacgagcgtcaccacacaagaaatttggagagattattccatactggacatatttccctgaaacatttatgaaggattctattacgaatccttcataacaatacactatcaatcagctatctacaccacaatgacggatttgaagaattttccgtcctcttttaattaatatactcttacaggtttaaagctctcccagcctttttcccaataccggatgcaccacatccgatgcaatctccgccagcgggtccatgacaaacctccgttcagtcatcaggggatgagggatttccaattccggcgtatgcagtattaaatcgccgtacaacaaaatatctatatcaatcaggcggtcactataattacctcccgccgacttcttcatccggcctaattcacgctctatctcctgtgtttcccgcaatatatccaagggaggaagcacactctccacgcaacaggcggcattcagaaaagaattttcagaagaaaacccccaaggggcagtaacataaaaagcggaaagggcagtaacctcccctatccgctcatttatcttccggacagcaacatgcagatttgattctttatcacccagattggttccaagtcccaaataaaccctcatacgctgctccaaccggtattacttatccaaaatcaacatagcgtcgccataagtaccgaaacggtaatcttccttcaacgctgtgtgataagcctccatcaccagatcataaccaccgtaggcagctaccagcatcagcaaagtggagagaggcaggtggaagttagtaaccatgctgttggctaccgagaaatcataaggagggaaaatgaacttattggtccatccgtcaaattctttcagatgaccatccgtacctaccgcagtctctatcgtgcgcatcactgtcgttcctaccgcacaaatattctttccttcatccttggcattattcacaatacggcacgcatccgcattgacatacatctgctccgaatccatcttatgcttggtaaggtcctccacatcaatctcgcggaaattacccagtccggcatgcatcgtcacaaaagcaaagtctatacctttgatttccatacgcttcatcaactcgcggctgaaatgaagtccggcagtgggagctgtcacagccccttcgttcttggcaaagatagtctggaaacgttcggcatcttcctcttctaccggacgacggatgaaactgggcagcggagcctctcccaacgcatacaatgctttcttgaactcgtcgtgagagccgtcatacaggaaacgcagggtacgtccgcgggaagtagtgttgtcaatcacttcggccaccatggaatcatcgtcaccaaaataaagcttgttaccgatacggatcttacgggcaggatctaccagcacatcccacaagcgaagttcctcattcagctcgcgcaacaaaaatacctcgatacgggcaccggtcttttccttatttccatacaaacgcgcagggaaaactttcgtatcattaaagataaacacatctttatcatcaaaatagtccaggatatccttgaataccttgtgttcaatcttacctgttgatttgtgaacaaccatcaggcgcgactcatctctatacttagccggatgcaaagctattttatcctccggcagtttaaatttaaattgcgacagtttcatcttatctctccttattcgtttataacttcttcaatctcttgttggtcaagccattccggaaaactttccaccgacaaacagtcttccagtctcacatcccccacccgggtacgtatcagccctgtcaaatgagcaccgctattcaaagcttcgccaatatcacgggccaatgcacggatataagtgcccttgctgcacactaccctgattttaatctcaggcagattacattccagcaactctatctcgtctataatcaacgtcttggctttcaactccacatcctcaccttttcgagccaaatcataagcgcgtttaccatctaccttacaagccgagaaaacaggcggaatctgttctatcctgccgataaaacgctgcaaggcttcctctaccaactcgcgggtgatatgttccgtaggataggtagcatctatctccttctccaggtcgaatgaaggtgtggtagcccccaactgcaaggtggcaatgtattctttggtatgatactggaactcttcgatgcgtttcgttgccttgcctgtacaaataatcatcaccccggtagccagcgggtctaatgtcccggcatgtcccacttttattttcttcacgcccagtttgcggcaaatatggtatcttatcttgttcaccactgcaaatgaggtccatttcagcggtttatcaaagtataatacttctccttctttaaaattcatccaattacatcaatgtgcacgctatcgtaacggcaccggctatggcacaatagatagcaaaataaatcaacttacctttcttcacaatattaatcatccacttacaagctacacagcccgatatgaaagctgccagaaaacctacaaccaatgacaatacagatatatctgatgtgccggctgcagctccttttacaatcttcataccatccagcaacgcctcacccaatataggaggaatcaccatcaggaaagagaactgagccagtttcgccttgttgtctcccaacaacaaaccggtagcaatggtagtacccgaacgggataatcccggcatcacggcacaagcctgtgccagacctataataaacgcatccttcatgctgatgttctctttcaaacgaggttttgcataataagagaaagcaagaagcaaagctgtcaataacagcatacaacctacaatgagcaagccggaaccgaaaatttcttccacataatctttaaaaaacacacccacaatgccgataggaatcatggataccaggatattgatcacatattttgtctccgcattcatctcaaacttgaacaagccgcggaatatccagcctatttctttccataatataaccaaagtactgagcaccgtagccacatgcactgctatggtaaaagtcagattatcttccccttgtatgccaaacaatgccgaaccgatagccagatgaccactactgctgaccggcaaatactctgtcaatccttggagcacaccaaggatcaatgcctcaaaccattccattctttaaataaaaattgagaattaaaaattaaaaaaatcaagagttaaccacttctgtcttgtcctttggcttgcggacaataccataaatcataaagataaagccaaagaaacatactgcgggcgccactttgatgcgacgtacactaaaaatatccggctcaaaatatccttctgtcgaactaggtcctgtcatcagcagaaaaccgacaataatcactgccatacctatggcaagcaatataaaattagttttatcaaaggcgaatttttgtctatccatatccttttattattaaatgtaatacaacgcactagctttcatgcgcaagtatttgttgattgatatatatgcacacataaaggtaataaccacaccaaacacaaaaacagaacccattaccataagcatggtcataggggtaataatctcaatcaattcgggttcatatcttaccaacgcataggccattcctatcaatgccgcatctgccatagcagcggccagtatccctatccatatattccgcaccaaaaaaggacgacggataaatccccagcttgcccctaccagtttcatggtatgaatcagaaaacgtttggaataaatggccagacggatggtgttattaatcagcgcaaaagaaataagggtaagcagcgcagccagtcccaatagcaaaaaactgattttccgtatattgctgttcactgcatccagtaaatcctggggatagttgatttccattactttcttgttctgcataattttctgctctatccaagaaatgctgtccgaattggcataatcggcattcagttttatttcaatagaagctgtaaaaggattatatcccaagaattcagccgggtctgtacccatcgcttcgctctgctctttcaacgcctgctccttcgatatataggaagtttctttcacaaaaggttcctcattcaattttttctggaatttcaaagcgtctgcttctttcatatcatcgctgatgagtacggagaaactgatgttctcgcgtacatacttggataagttattggcagacagcacaaagaataccaccatccccaacaagagcaacaccagcattgtactgatgctggaggtaatgaactgcatatcgaaaaaggaccctgatttttttcccataatcacttctttctgaatacataaatcattgaactactgcgttcttttttcgccagtgaactgaaccaggccaacaggcccgtccacattcccttcaaaaaggacaaacggctgcctttatatctttccgtcaacatggatacataaaaagcatcaaaaggcatcggatgctgttccgctaatttaaaaccatgcttgacaccgaattgttgcatgacggaaggtgtaaaatgccataaatgacggggcacatcgtatgccgcccaccattccttatacttttccgcatcatacgaactgggattaggcacagccactatcaatactcccctctctttcaacagcttgaataatttctcccacgtttcattcagatgctccagatgctccatcacatgccataaagttatggcatcaaaagaatgatcggcatatcccgccaaagcatcctccgtatctacatccaattcaaaatgctctttggcaaacgaacgcgcctgcggacttttctctatcgctttcacccgccatccgcgctccttcatagcattactgaaatatccggtaccggtacctatgtctaacaaagtacctttactcaaaccggatgtccgttttatcagcttggctttgcgtgacagcatatacttgcgtacctcatggtatacacggttcatcagccccttgcgggtatcagtgtgtgaaatataatcgggggtctcataatatcgccctatctcggcttccacgggtgcaccttgtgtaaaaataaagccacaatcatcgcagcgaaccaaattgaattgttcacccgaagcatagtgatccgtacaagtgattgcatgtcccaaatgttttccgccgcacaacggacaagtatttattttgagtatatccactttttgccctaatttgctgcaaaataacaaataaattgaatgagaaggactatcctttaagtacttttaagagtataagttaataattcgtttttacttttcctacatttgtgcagataacttaaaaagaaacgaaaatggaaaataaaaaactgacccgttccaacaacagaatgctagccggagtatgtgcgggactggctgattattttggctgggatgttacggtagtgcgcattatctattcatttgccacggttttcacagccttttcgggcattattgtctatataatcttatggattgttatgcccgaaaagaaatatcgtgacggttacgaagaccggatgaatgacagactgcataaccgataaccggaggcattatgcaatgcccagcagttccacctcaaatattaatgtagagaaagcaggaatcggcccgcttgtacggttgccatatcccatagtataaggaatataaaccacccatttatctcctacatgcatacgttgaagcgccagctgccatccctctatgacatcacacagccggaaagcttcggggcagttacggtcataggaattatcaaactcttttccgtttatcagacttccccgataatgaacggtgacaatacttcggattgtaggtgaaactgtacccgtacctgtctgcaatactttataaaacatattacaaggtaaaggacaaataccttcctgtgtagaaagaacttgcaaatattgcaagttcttttccttatattcttcttttctccccatcagaacacctcttctcctttcaatgtggccgaactggcttcagtaatgcgtacatggacaaaatcaccgatacgatgattcccacgatcaaagaccaccaccttgttttgctgtgtacggccaaaaagctgctctctggaacgcttggaaacaccttctaccatcacttcgaaggtcttgcctacatcacgggcattactttcggcagaaagacggttctgcaattcaatgatttcattcagccggcgtatcttaacctcttcgggtacatcatccggcagatgcttggaagcatatgttccgggacgttcggaatatttaaacataaaggcggaatcgtacgcacactcacgcatcaaggatagagattcctgatggtcttcttccgtttccgaatgatagccggagaaaatatcagtactcagaccacaatcgggaatgatacggcgaatagccgctaccctttccaaataccactcacgggtatatttgcggttcatcagcttcaatatgcgcgaactgccgctctgtaccggtaaatgaatatgcttgcatacattaggcgtttccgcaatgacttgcaaggtttcatcactcatatccttgggatgtgaagtggtaaaacgaacacgcatgtccggaaccgcctcggccactgtgcggagcagcatcgggaaagtaattatttcaccctctttctcaaaacgataagaattcacattctgtcccagcaacgttacttctttataacctttgtctgccaagtcacgcacctcattcagaatactttccacatcacggctgcgctcacgcccacgggtatacggcacaatacaataatgacagaaattattgcaaccacgcataatggatacaaacccggagatatgattgccgcaaatacgggacggaattacctcacgataggtttctgtagtagaaagctccacattaatggctttctcccccgcttccaccgaagcgaccaaatcgggcaaagtgagataggcatccggtcctacgacaagatctacatgatggttctcgatcaaatcatcttttacacgttctgccatgcagcccaacacaccgacaatcagattccggcgtttgtttttcttcatagaatggaaaaactccagacggttcagaatcttttgttctgcattgtcgcgaatggaacaggtattcataaatacagcatccgcttcatccaatgtttcgcatacatggtagcctgccatttgcataatagaagcaatcacttcactatcagcaacattcatctggcatccgtaagtttcaataaacaatttcttgttttcggaatcagttgcagatttaaagtctgctcctgttgtttctttcatattttctctgttttatggtttcgtaggcaaagatacggagttaccgacaaattaaacgaataaaagagccgaaaattgaatattataagagaattatgcatttaactgttaaataattataaccagtgaacaaaaaaaaccgttaacgttaccaacgtattattataattcgcatatttgcttccgaaaaacattagattttttcatagttaaggtttaggttaaaaaaataggggaagacaactgtgaagttctcttcctttttttatgcccttttatagagttagttatgaaatatttttctaactttgagcattcattatataataaggaaagtatggatatcattcaggttatcatatttataataatcattgttgcagccatcgtgcaacaaatctcaaaaacaggcaaagagaagaaaacaccttctccaaagaaagtgcttgcagatatatttcctgaaatagagcaggagaacatagaggaggaccttcctgtttcttccgttcaaacagtccgcacacctcagactccccgcatgcagcatcagccgatggtcaagaaaccaacagattcaccccggaaagagaacaaaagggaagaccggactcctataagactgagtactaaagaagaggcacgacgtgcttttatttattcagagatttttaatcgcaaatattaataacaactatactaataagaataacacattgaatatcatgggatttaatattatttccgcagccgaagcagccagctatatcaagcatggctacaacattggactcagcggctttactccggcaggaacaccgaaagccgtaacacccgaagtcgcaaaaatagcagaagaagaacatgccaaaggtaacccttttcaaattagtatctttaccggtgcttctacaggagatgctacagacggcatcttatccagggtcaaggcaatccgttaccgtgctccttacacaaccaaccccgatttccgaaaagccgtaaataacggcgaaatagcatacaacgatatccatctgtcacaaatggcacaggaggtacgttacgggttcatgggtaaagtagatgtcgctattctggaagcgtgtgaaatcactcccgacggcaaagtttatctgacagccgccggtggaattgcaccgactattgcacgtctggcagataaagtgatcatcgaattgaacgctgcccacagtaaaaacggtatgggcctgcacgatgtttatgaaccgcttgacccgccttaccgtcgtgaaattcctatttacaaacccagcgaccgtatcggtctgccttatgtacaggtagacccgaaaaaaatcatcggcgtagtggaagtaaacacccctgaccaggcccgttcatttaccgcaccggatcctatcaccgaccagattggacaaaatgttgccgacttcctggcagctgacatgaaacggggtattattcctgcaagcttcctgccattacagagtggagtaggtaacattgctaatgccgtattgggtgctttgggacgagacaaaacaattcccgccttcgaaatgtatacggaagtattacaagacgcagtggtggacctgattcgccaaggacgtgtaaaatttggaagtacctgttcattgactgtcaccaacgaatgtctgcaaggtatttatgatgatatcgacttcttccgtgacaaactggtcatgcgtccgtctgaaatctcaaacaacccggaaattatccgtcgtcttggtgttatatctatcaatacagccatcgaagcagatatttacggtaatgtaaattctactcacatcagcggcaccaaaatgatgaatggtattggtggctcaggtgactttacccgcaatgcctatatttccatctttacttgcccgtctgtggcaaaagaaggaaaaatcagtgccatcgttcctatggtttctcacgaagatcacagtgaacacgatgtcaatatccttattactgaacaaggtgttgccgacttacgcggcaagagcccggtagaacgcgccaaggctatcatcgaaaattgtgcacatccggattataagaacattctttgggattatgtaaaaatgtcttccaaaggacaaactcctcattgtattccggctgcattggctatgcatgatacgctggccaagaaaggggatatgcgcctgatagattgggcagaatataaatagtcattatttgctgtatctcatacgtttccggtcggtacgatgtatccggccggaaactttttatatctatcccacctttttgtataaaaaacaatatcttccacctttttaatcaaaaaatacacggacttttttcataattattctatttttgccgtgtaactaatcatttttaccattttactatgagaaacaaaattctatatttatttgcttcccttgtgatgctaagcggctgtaacaatcaaccggcttataaagacagcagtttatctcccgaagaacgggcagaggatttattgcaacaacttactctagaagaaaaagttgccttaatgatggacaactccaaacctgtcgaaagattaggcattaaaccttataattggtggaacgaagccttgcacggagtggcacggagcggactggccaccgtctttcctcagcctataggtatggcggcctcttttgagcccgatgccatacataccatctataccgcagtttcggatgaagcccgggccaaaaatgccgcatactcggcggcgggaagctacgaacggtatcaaggcctgaccatgtggacacccaccgtcaatatttatcgcgatcccagatgggggagaggtattgaaacgtatggggaagatccttatctgacaagtgtcatgggggtaaatgtggtgaaaggattgcaatgcatggatgctaatcaaaaatacgataaaatacacgcttgtgccaaacactttgccgtccattcagggccggaatggaatcgtcatgagttcaatgcggaaaatatcaaaccgcgtgacttgcatgaaacttatcttgtacctttcgaagcattagtaaaagaagcaaaagtaaaggaggtaatgtgtgcctacaaccgtttggaaggcaatccgtgttgcggaagtgaccgcctgctgatgcaaattctccgtcaagactggggatatgacggcattgtactttcagattgtggcgctattgacgatttctatcgggaaaaaggacacaaaacacatccggatgctgaatcggcctctgccgccgcagtattaagcggtacggatctggaatgtggttccagttataaagcattggtagaaagcgctaaaaaaggattaatcagtgaaaaggacattgatgtatccgtaaaacgattattaaaagcacgctttgaattgggggaaatggatgatcctgacaaagtggaatggactaaaattccttattcagtggtttgctcggcagaacatgattccctgtcactagatatagcacgcaaatcaatgacgctgttactgaacaaaaataatatcctgccactgaaacgcggtggacaaaccatcgccgtcatgggacctaacgcaaatgattctgtgatgcaatggggtaattataacggtactcccaaacatacgatcaccttattggaaggtatccgctcagccatgggagagaatgacaaactgatctatgaacaaggttgcagctgggtggagcgctcattaatcagaagcgttttcagccagtgtacttctaaagaaggtccaggattctccgcccgctattggaacaacaaggaatatgaaggaaatgcggtagccaccgcacaacttaccacaccgttccgtctttgcacttccggagctaccgtatttgctcccggtgtgaacctgaccgatttctcggccgtctatcaaagtgtgttcaccccccaggaaacaggagaggttattttcaacttctatagttgtggagctacacaattattgataaatggtgaagaagtaaagaaattcaccaacaaacatgggggcaggggacaagcttacgccatgcatgcagaagccggcaagccatacgatatagaaatccgcttccaatactttagtggagatgcacagttgaatttcgatcttggatttaaagaagaagtcaacattaaaaacacggtagcaaaagtgaaagatgctgatgtagttatatttgcaggcggtatatctccaagtttggaaggagaggagatgggtgtcaatttaccgggattccgcaaaggagaccgtactgacatcgaacttccggctgttcagcgtgaattgataaaagcactctgtgatgccgggaaaaaagttattttcgttaatttttccggatcacccattgccatggaacccgaaaccaaatattgtcaggccattttacaagcatggtatccgggacaatccggaggtaaagctgccgccgaagttttgtttggagattacaatcctgcaggacgactgcccgttactttttaccggaatataacgcaattacctgattttgaagattataatatgacaggacgtacttaccgttattttaaaggtgatcctcttttcccattcggttatggtttgagttataccacttttaactatggtaacatcaaactggagcaaacgattaaagtaggggaaactgccaaaattattgttcctgtaaccaataccggtaatcgtgacggggaagaagtagtacaggtatatctgaaaaaacaagaagatgcggaaggaccggttaaaacactgcgtgctttcaaacgtgtacaaattcctgcaggaaaaacagtcaatgtagaattagagttaacacccaaacaattggaatggtgggacgcgcagacaaataccatgcgcaccatagccggaaacttcgatataatggtagggggtaattctaaagatgccgaattacaagtaaagacgctgacactgcaataataactccgaataaaataaatcaagtctgcggcatttttgttttaaatatagaatttgacaaaaatgccgcacttgacaaaataaaaacatcagaacaactcaatctgcttatctgcctttatttgttgcacaaaatagttgtcatgactcaccaccaacaaagtgccttgataatccttcaaagtttcggtcaatatctccatactcagaatatcaatattattagtaggttcatccacaataaaaacatcgggggcctgtgcactcaccataagacaacagagagaaagtttcatcttctcacctccactcagatagctacacttcttgttccatgtggaaacaggaaacaaaaaacggttgagaatcgttctcaattcattatcatacaattcactattgaataaggcaaattgttccaataccgacaaatcattacgaattatagaatattcctgatcaagataaacgtacgtcagcccttctgcctgtatcaaagaaccttgagtaggagcaagacttccggttatcaacctcaataaagttgttttaccactaccattacttcctttcaaatgaatacggtcaccacttttgatggtaaactcaagaggagaagaccacaaaggattttctccatacgaataattcacacttgaagctacgataagtattttaccgatatgcaaagaagatgaattgaaatttactttcatcgtcttcatatcaggtaaagctttatgcagttctactgtttctcctgccaaaaaacggatcttatcaacatgaacatctcctaaacggacagtacttttctcagcctgatccctgaatgtatgcattgccatctttccgactcctttcttcacattttgttttttacctcgcacatcatgcttttgttgacgctccattacctcacgtgcctgcttccgggctttttgtaattgcttttcattctccttcaaccgggtttgcagagcttctacagccaatttcttctgttctttatagaaatcgtaatttccagcataataagtgacaccttttgcagtaagctcataggtagaaaaaagtaaattgagtaatgtccggtcgtggctgacaaccagtatccctgctgcagcagtagttataaaacggtacagccggatacggctttcgtcatccaaatgattggtaggctcatccatcaaaataaaagcaggagagtatatagtaattcctgctagaaaaacttttgttttctcaccgccactcaacaaatgcatgggataggaaagaggtactcctaccaacccccattcattcaaagcagcaaccgctttctcttctattttccagtcatccgccaaagccgtaaaatgctctatcgaagcatctccctgtaaaatggcatgaagtgcatataactttctttctattcccaatgccccggctactgtcaaatgattaaactgaccaaaatgctgtggaatagaataggggatatccggacatataatttgtccttcagaaggtaatagctctttagttatcaatcgcatcaaggtagattttcccgaaccgttgtttccgatgagggctacttttttccctttactgatagtaaaactgacattactgaaaagcacatctttatccggatgcatgtaagtaatggactgtacatgtatacacatactctttctaagaattttaaatatgaatactgaaaagttcgtagttggaataagaagacaactattgcgcaacaaacgaaattatttcgcctgctgtcccaacgtaaaaacaaatagttgtatggaaatgaatgttttaaattctcatcggaatatttttaaatttgcgaggcaaagatagcaggtttatggaacataaaaaaatattccccaatctaaatgaatagattgagggtaagcattcggcctcgtgcgtgtttttttcccctcttttccttcctacctttgtgatatcagaaggtggagatagaaaaggatggaacggtgcatctgaccatcattccaggtaaggtaaagaccatcaacctttgaagggccttgaagagaacagaaaatgaaacggaacaatgatccggaagtaagataatatattgaaaaaaagagaagctgtctcaaacttgaattacaagatgagacagcttcttttttattgtttcatttcacgcaacgctttacataattgatccgggcaggaggtggagcggtttccgcattttacaccttccagtttctgtaagacctcttccactttcattcctttcaccaatcggctgataccttgtaagtttccattgcatccgccccaaaagaaaacttgttgaataacgtcatcttctacttccacttcgatgtggctgctgcaagtgccttgcgtcttataggttattttcattttattcttcctcttcagatgcaggtttcatgtttgtataaacggtctgaacatcatcaaattcttccagacgctctaccatcttgtctagagtttcacgttgttcaggagtcacatcttttaagtcattgggaatatatgtgaaatcaccacccacttcttcgaaaccacattcttccaagtgtttctgaattgctgcgtagctcttcggatcaccatagatggtgatagttccttcttcttcatcttcgtcgaactcatcctctacattatagtcaatcaaatccaggatcagttcttccatatccattccttctttcttcttgaaagtaaatacacatttatggtcgaacaagaaagctaaggaaccggtagtacccaagtttccaccgaatttgttaaatactgaacgcacatctgctacggtacgggtagtgttgtctgtcaatgtatcaacaaatacagctactccgtgaggaccatatccttcgtaagtcatacctttgtagtcactggtatctttacccattgcattcttaatggcgcgttcaatgttatccttcggcatgttttcacgcttacaagtagcgatcacaccacgtagggtcgggttattttcgggttccggaccacctgcttttacagctatagcgatttgtttacccagtcttgtaaatgttttggccatgtggccccatcttttcagctttgtagcttttctatattcaaatgctcttcccattggattgtagttttataatggttatttttattattatcttagttttgcacctagtttgttttctaggttagcaatcagtttggacatgatcttgtcaatctgtttgtcgttcagtgttgcgctttcatcctgtaacaagaagctcactgcataactttttttacccggttccagattcttgccttcataaacatcaaacaattctacttctttcagcagtttcttttcagtctcataggctattttttcgatttctgcaaactgtatgttcttgtcaatcaacaaagccaagtcacgtttcacagccgggaacttggaaagttctttaaagttgactttagccgacttgatggctttcatcagttctttccagttgatttctgcataatatacctcattgtctatatcgaatgctttttgaatcttcttgctgatgatgccgaaggtggccaataacttgccgccacgtgtgtgtacgctgatggctgttgaatagatatcgttggtcaggttgccgaataccacgttgccgaaattcaatcccaaacgggtaaagatgttcagcacgtatgcttttaattcgtaaacactgctgttttcatcgggatgggcccatgaattgctgacgcgtttgccggttacccataatcctaaatgatattcttcagcataagccgcaagcactttttccgggttcttcttttctgcgttataaaaatagcagttaccgaattcaaagaatttcaaatcggcgttcttacgattggcattgtgctggatactttccaaaccaccgaataacaaagtttgacgcatcacgttcaaatcgttactcaatgggttcatcaagtaaaccaaattttcgttcttgtatgtttccgacccttcgtaataggaagcggcggtcagtgaattgttcagtatttcattgaaaccacaacctaccagttgctctgaaatcagattttgtaatttctgggagtaatccacttcacctttggtggtcaggctggatttcaaggtagtaggaatctccacattattatatccgtagatacggagaatgtcttctactacatcgcaatcacgttgcacatccacacgataggggggaacttgtaaagtcaagccttcgggtgtttcgttcacaatcttcatttcaagactggtgacaatgctctttatggtttccaccggtatggtttttcctatcagtgagtggactttctcataattcagctctactgtaaaatcggctatcggggcagggtagttgtctttaatttcagaagaaatagtacctcctgccagttcttgaaccagtaaagccgcttctttcaatgcataaatagttccgttggggtcaataccacgttcgaaacggaaagaagagtctgtactcaatccatggcgacgggctgttttacgtacccaagtcgggttgaaataagcgctttccaaaaatacatctactgtctgctcggttgttcccgaatccagaccaccgaatacgccggcaatgcacatcggttcttcagtgttgcatatcatcaggtccttgtcggataatttgcgttccacttcgtccaaagtaacgaatgtagtaccttcggcaacagtcttcactacaatcttaccacctttaatcttatctgcatcaaaacagtgcaggggctggccgtatgcgtgaaggatgtagttggtgatatccacgatattattgataggacgtactccaatcaggcgtaatttgttttgcagccattcgggactctcttttacagttaccccttttatggaaactccggcataacgcggacatgcttctgtattctctacttcaatggcgatgtccatatcatggttatccactttaaacgcttctacagacggacgttttaaagtggcttgtttgccgttttgaatcaggtaggcatacagatctcgggccacgccgtaatgtgagcaggcgtccgcacggttcggggtgatatccacttccagtacgtattcgcttttgatattgaaataatctttagcgggagtacccggaacagcatccgccggcagtacgatgataccttcgtggctgtttccgataccgatttcgtcttcggcacagatcatacccatagattcaattccgcggagctttgatttcttgatggtaaaacattcttcgccatcgtatagcttggtgcccaatgtggcaaccaccactttctgtccggcagctacgttagcggctccacagacaatctgtaccggttcgccttgtcccaaattcacagtagtaacatgcatgtggtctgaattgggatgaggttcgcaagtcagcacttcgccgatgacaatacctttcagaccacctttaattgtttggacttcttctacgcctccggtttccaaaccgatggaagtcagcgcttcggccacttcatccggtgtcaaatcgaagttgacgtattctttcagccaattataagagatattcatatatgatattttttatgtatttccaaatgacctgcaaatttagtaattattttcttttatcctgttatttatccatcacagattactcagattaacacagatttttctttgagggaaataatccgtgttaattctgtgagggataaataaatgtcagaacggtaaaggtccttcgggaataggggctccgaacggattattgtcggcaggtgcggcatcaggagatgggggaggtacactgttgccgccaccgttcattttggaacggataatacccggtgcctcacccggcataggcacgatgacatcatcgtccggattctggaagcgggcgaattcgccacggaaacgcagcagtacatcacctacggcaccgttacggtgcttggcgataatgatttctgccataccgtgcaagtcgttccctttttcatccgagtagattttatagtattccgggcggtggataaagcataccatatcggcatcctgctcaatagctccggattcacggaggtcactgagctgggggcgttttccgtcaataccctcacgactttccacaccacggttcagctggctcagtgcgatgatggggatgttcagttctttggctaaccccttcagtgaacgtgaaatggtactgacctcttcctgacggctaccgaatgacattccgctggcattcattaactgaaggtagtcaatgataatgatttttactccatgctcgcgtacaagccgtcgtgctttggtgcgtaattcaaagacggacaaggatggtgtgtcatccacatacatcggagcatcgtataattcttttattttataatccagttgtccccattcatacggagccaactgaccactcttgattttctcacccggaatttcgcacacgttgacaatcatacggttgactaactgtacgttggacatttcaagagagaacaaagccacagggattttcgcatttaccgccatgttctttgccatggaaagcacaaaagccgttttacccatagcggggcgggcggcaataatcaccaggtcggaattttgccagcccgaggtcattttgtccaatgcatggaaaccgctttccagaccactcagcccgtccgttcgtgccgccgctttttgaagcatctcatacgcttcctggatgacagggttgatttgcgtataatccttcttcatgttctgctgcgagatttcgaacagttttccttccgcttcctgcatcaggtcgtccacgtcttgggtttcgtcgaaagcctttgtctggatgttgctggtaaaggtaatcagttcgcgtgcaagaaacttctgcgcgatgatacgtgcgtgatattctatgtgtgcggaagaggctaccttgccgcttagctgtgttatgtaaaaaggaccgcctgcatcttccagttcaccggtgctgcgtaattgttcggccacagtcaagatatcgactggttgctggcgtaaagccaaagaggtaatagccgaataaataagttggtgacggcgttcataaaaagattcgggacgaagaatctcacttactaatgagtaagcatctttttctatcattaaggctcccaatacagcttcctccagctcaggtgcctggggctgtaaatgtccgtattcgtcaacaggctttgctttcgaagttttgggagtacgtgtcatttttctcgtttctgccattgtcgtctgtttaaagtagggcaaagatagaactttttgctgagttggacactcgtccattcccaaaaataataaaagaaatatgaacctgaatatacggagaaatgaacaatctggacagtaaatggtttttttatatggtaaaatgaaaagtttgttctatatttggcgctctgtccggataaaagatggcgtgcatctttgtagaacgggcaacaatctaacgaaacacactaaaaataactatttaaagaacagaatatgattacatttcctaatgcaaagattaatttgggacttaatattgtagaaaagcgcccggatggataccacaatctggaaaccatattttatccgataaacctgcaagacgctctggaagtgacgcggcgggaaaacaatgacaaagaatacactttacacataagcggatctcctttggagggtgaacccgaagataatctggtagtaaaagcctataagttattaaaaaaagactatcccggactgttgccggtagatatacacatgtacaagcatataccggcgggtgccggactaggtggcggatcatcagatgccgcttgtatgataaagcttctgaatgataaattttcattggaactcagtacggaacggatggaggaatatgcggtaaaactaggggcagactgtgcttttttcattcggaacaaacctgttttcgctaccggaatagggtatctgttcgagcctgtggaattgtcattaaagggataccatataattttgattaaacctgatatctttgtgtccacccgggatgcgtttgccgaaataaagcctgtgcgtccggctgtttctttgaaagaaattgtaaagcaacctatggaaacatggaaaaacagtatgaagaatgattttgaagatagtgtcttcaaaaagttccctgagattgctgctataaaagatgaattgtatgatttgggggcagtgtatgccgccatgagtggctcggggtcttccgtctatggtattttcaaagcaccgatagagaatgtggaagataaattctgtggatgcttttgcagacagagagcgttggaatagtgtggcagatcagtggttagtgattagtggactgcgctgtcatgccgcaggtattaaccactaaccactatagtctatcttttacatagtgccttgaaatcacaataggtacatttttctatgatttctgtttgggtaaatgatttttccggattaaatatctcttctaataatccttgaagtcgttcacggtattctttttcatatttactgaaatcttccacagcctctttgggctttcgtggctcgcccatttgtataacgagagaataggtttctgtagcggcccgatgaatatagagaagggccggagctatcttcatcgttggttgcttgcggcacatgatggcggcatacaggaacgtctggaatacatagttggaacgtttcttgtccggaataaacagagattccacatggggtggggtgtctgcatcaccgcctgtcttgtagtccacaatacggagtgtgccatccttgctgtccatacggtcaataattcccccgatacgtgattttatgactcctttgggtgtttgtatgtcgatgggttcatccacttccatttccgatgcaataaaagtgaagggagcgtaacgtaaatcattttgtaaaagttgttttaaatatcttgcaataacggcagagttgataagttgtacgccgttatattccggtttctcgttttgcggaacattaaagaataatttcttgaatgctgtatccacataatcttgcagcttcacttcattgcgtagcaacgtttccaatgcttccttattaatgactttgccatgagtggtcaggtctttataaatatgttcggctgcataatggaaaatacttccgaatgtggcagaatctatttccgcactcacttcatcgggggcggagaggccggctacatacctataataaaattttaaaggacaatccaggtaataattcaaggctgatggagaaaattttgctttgggattggcacggacatcaaacaggctttgcatccggcgcatgacatccggggtcttttctacagtgataggcgaggtgccttggggggactgtccggcctccagaaactgacgtgtgatggggtgaggccattcaatcaggaattgcagcatgaaacggctccattcgccgcggttcagtccgtccgaactggtattgtacatcaaggtaatcctttctgcccgttgcagcagacgatagaaatagtatgcatatacggcaatcttatgctctatagtagtcattccgaaagctttgcgcaggttgtaaggaataaaggaagagtctcctcccgatttgggaagctgcccttcgttgaccgatagtaataccaagtggcggaaatccaggttacgtgtttccaatacccccatgacctgcataccaatggccggttcgccatggaatggaatattggtcgctgacaagaccttgaccagcaatcgccggaatgtttcgctctgtacggttaattcatcttcttctatcagtgtgcggaaccggttgatggtggtataggctttgaaaagcgactcccggtaaagttggttgaatgcatctgtgtcttcggtaccggaagtgtttgcctggtaaatgcctgccacttgctgcaaagtttcggacaggcgtatgcacagattcaggtttccggaaagcggagtgaaaagccgggtaaggaattcatctttacccaattcgccgggtaacggatagaaacggttgttccgggtcagttctttttccaacaattcggcttgaccggtgagttgccgggtataggggtgttttaacagtgtaacaaccgattgaaacgtgtagcggccgcttttgaaattaaatccgtgggtatgcaactccagtaaggcgatgaggaaactatatacaggagtttgcgataacggaaatcccatggtgatattgacatgttttacttctgccggcaatgaatggaggaccggctgaagcaatgcttcgttacacaatacgactgcggtttccttttccggtgtagtcagattgtttcgtatccattgaggcaggtaacgggcttgtgcattttcagtagaagatgcgatgtagtgtacctctttaggtttcgagagatttttgaataactcaccggacaaaggagaaggaaagtcgcgtaagttccggcggataaactctccggcttcatgggtgacggcttgtctgttttccttcatataaaattcgtcgtaatcccaataaaaaacagctttcccgacatctttcaattgggtgaacaacgtatgttctactttgttcagtacattaaatcctacaaaaacatatttctcgtatggaagtttgtccacatccagatgctctatgacgtggcggtacatcattccttcgtaggcaatgttttgagaagctaaggattcacggaaccctttgtagatgtttcccaatacgtcccataaagagataaaccgttctttcagcgctgttctccgttcgatggagaagttctggaagaactgccggatagcttcttcctgctcatcgtcaatgaaggtgtagtcgtccattatgttgcgcagatcctgtaaattggaaaacagtttgtcggtatccactttatttttgtcggcatcgtcaaaatcactgatcagcatttctccccaaaaatagaaatcatccagtgtttccgtactttgagtttcccgtcggaatattttataaagttcgcataccagttttaccggatcacccacttcccacggagaaaggctacggaacaattcgctgatgctgacgtatgcgggcgaccaaataggtgaatccgactcttgggcgagatactcattaaagaaaagtccggcacgtttgttaggaaaaaccacggctgtatgtgccaggtttccttccgtatgtttatataaatcggctgctaccagtttcaaaaagctttccattattctatttcctccagttcgttgttaaatacataccataaatagccacggatatgctcatatcccatatccgataataaatccatatattctttcacctgcttgttgtaagctttccgctttttaccgaatttaaagtccaccacaatcacctctccgtctttcatcatcacgcggtccggacggcgggtttgcagcactcctttttcccgataaataatggcacactcattgtatagttcccagcggcccgaataccattctttgaccagcggatgcttcaaagcccattcggtgagttttcgtatttgttcctcctgttgtgccgactctatgattccttcgaaacgcaggcgttctatggcgggaggcacatcgtccggggtacggattacggagaacagattatgcaacaactgtccttgccggatgtatttgtcttccgtctcctcttctccccggataaattcggcagaacggttggactgtttgaattcgatgttggtttccagcgtttccagatggataggcaaacgtcgggctacagtcagcagcttgttgccggacacttgtttttcctcttcgtgagatgagagatagagcgttcccagttcgtatatttcttctccggtggcatagctctttccggtcatgtcggataaggcacttcctaacaattcggataccgttcctttctgttccgcctttccatatataatcaagttctttttggcacgggtaaatgccacataaagcaggttcagattatccacccataattgcaagcgttcattcaggaactcttcccgataaatggattgctgcatggctgtggaatagttgatgggaacaatgtcaagatcgctaaacggagcttgccggggagcacaccataccagatgattgtaagtctcattctccattttccagtcgcagaagggtagcagtacggtatggtattccaatcctttggacttgtggatggagagaatgcgaattccttccacctcgccggaagggatggttttgctgcctagtttttcttcccagtaggtgataaaagcggataattcggaagaattgctttgcagatattccgtcacggcatcaaagaaggcgcacagataggcatcctgttgttcgatgcaggacatctggaacagattgaaaagtttttccatcagctcatacagtggcatgaggcgaagttgctccgcttcttttatgaaatcgaatggcagataatcatctattccgttcagcaatagagtgttgaggtctattcctttatgtaatacttcattctgataggcagcagccagttgcgccttggcaatccggttttcgggttgtgacaagtagcgcaggccatccattatcatacataccgccagtgaggcatccagtcggaatgcctcatcggatacgattttgtaagaggtgttcttgtcgaagtaatcggctattaaaggaatgcttctgttcttgcgcaccaggatggcaatatctttcagttgcacgccctgcgccacaagcagctccacttcttctcctaggtggtgcagggtgttttccatataggtcatgtcttccgtatccgatagaaattccactttgacatacccttttccgggatctttgtatgtttcctgacacacgtcgttgtaggcttccttcagttccttgcattcctttttttgttcttccttgtaaatgttgttcaacacctcgcaggcggctgtaaacacttcgttgttgaagtgaatgatgtttgcggcgctccggcggttggtggtcagtgtctttactttgacgggaaaggcttcgatgtttgttttcaatccgttcagtatgccccagtcaccgtttctccagcggtagatggattgtttcacgtctcctacaatcaagctgtctgctccctgagacaaaccttcgagcagcaacagacggaaattgtcccattgcatacgcgaagtatcctgaaattcatcgatcattacgttgcgtatggttgttcctatcttttcgaatacaaacgaggaatctccttcttttaccaggttatgaagcaacgcgttggtatccgacagcaggaagcggttgttttcatggttcaattcgcgtacctcttcgtctatattggccagcagacggatattgtttacgtggcgcagggagagttggcaggaattggccagcatattgttccggcttctgtatttttccgattcattcagcagaggaatcagttctttttctgccagacctaggatagcgttgcgtatgggagaggtttttttcacccattcgtcggggcagtccagacatttttccactgttacattgcggacactgtcatccagtttacccgattgtaatttattaaaatagctggctatacctcgggagccgtttttcaaatcttctactttcaccccgtttgtatccaatattccgaagaattggtcggcaaatcctttcatttgttcctgcacctcttccaaaatggcttgcagcgtttcgcggtaattcttgatacagtctttgtcccgtaatttttcccgtagtccgtttcctttttctatatatccttcatcgaagatatttcgtccgaaattctttatctcaccggaaacattccacctcttgtcatcggctattctttcttctatgtattccaacagccaatagagtacgggagattgtcggtccagcttttctatcatggagtccacggcatcactcagaacttccatattgttcagttcgatattcagattggcacccaattccagctcccgtgccaaattgcgcatcaccgactggaagaatgagtcaatggtttccacccggaagcggctgtaatcgtgtatcatgtagtgcagtgccgtaccggcggctgtccttatgtcttcttggggcatttccagttcttctgtgattttctgtaaatagggatcagaatccttatcctttatccatattccgtatagctgactcagaatccgctctttcatttcggtagtggccttgttggtaaaagtcacagccagtatattacggtatgcccgtgggttctgtatcagcagttttatatattccacggccagtgtgaatgtttttcccgaaccggcagaggctttataaactaataattcaggagaatgtttcattttaaataatttgctaatttgctaatggctgcgctgtgtaccggatggtaattggctgacacattagtacatttttatttttaattaaaaaccagcacaaaaacagtggcctgtcccttttccttgtaaggcagcagggtcagtgtgccaccgctcagtctcatgatttgtttgctcaggctcagtccgatgccgcttccttcctctttggtcgtgaagaaaggtacaaaaatttgtccggctgcatcgggaggaatggcgggaccgttgttggctatctctatacggatactttcttgcggatcacaataagctttcaaggtgatctttccgtcgggagcattacctatggcttgaatcgcatttttcagcagattcgtaaccacttgggctatcaggttctcgtcggcaaagactatcaggtcttcccgggcttcgaggatggaaagggtgatgttggggcatggatgctggtgctgtgccagtcggatcatccgttccaggaaaggacggacatagaacagcgatggctcaggtgatggcagtcgtgtcagtttgcgataagacatgacaaaatttatcaatcctttacctgtagagtgaatcgtttccagcccttgtttcatttcttcattttctgctccgggaagagccagcagcgtttcgctgagggaagtcaccggggtcagggagttcataatttcgtgtgtcagcacgcgggtaaggcgtatccatgaatctatttcccgttcatccaattcccgattgatatcactcaaggcaataatgcggagttcctcgtctttgatacggatgccggacacccgtaaggcaagatgcaccgttccccgttccgtattgaactgaatttgcagcttgtcacccggaactgctttttccaaagcagtcatcagttcgtccgagatgcgggagagttgtttgacatgagtcagaacatccagccccaacagattcatggcctctttgttcttttgataaacggagcctttgctgttcagtaccactatgccggtttctacaaagtccatgatgagctcataatacttctcgcgttgtgccgtttcctgttttacattgtacaaaatacgtgcgatacggttcagcatgacattgaccatggaagaatcgccaggggaggcatgttcgtaaaaacgaacagcggggtcgtcgttttcgatggcgtcgagcagaaaggctatcttccgggtattaaaagtgtacaggcggtaaaaccagcctatggaaacgaggaatgaaggtacgattacgcatagccacaaccagttgcgctgctggattagtaaggtgcaggcaatggctagaaccagtacggtaaataggcggaagaagaattgtttcacagcttaattatttattatttcgtttgaatgttcctttagttcctgtttaaaaatagattattgttatttgttttgtcatcctgaaccatcgtgaagaatgagatgagataataggtcataatccgaattttttcatcttattataaagcgtctgccgggtaattcccaactgtgccgctacagccgagaggtttccgttgcatttctctatcgctttctgaatcatttgcaattccatctcttccagtgtagagacacttgtttctgtcgcaggagccgctatttttcggggaaaatgaaaatgttcctcactcaatataccatcttcattgataatgaccgctttctctacggcatgttccagttcgcgtatgtttccataccacggatatgtccgtaacttttcttgcgcaccggtagaaagaaggatatttcctttgtcatattgtttgcagaaccggtctataaagcgttcggccaaagggataatatcttctttgcgttcccgcagagggggaatctcgatgtggatggtattgatgcggtaaagcaaatcttcgcggaatttgcctttggccaccatctcttccaaattacaattggtggcgcaaatcaaacgtatgttgacaggtatcggttcgttgcttcctactcgcaccacgctccggctctgaatggcggtgagtagtttggattgcaggtgatagggcaggttgcctatttcgtccagaaacaaagtcccttcatgggcggcttcaaatttacctgcacggtcggtatgggcatcggtaaacgagccttttttatggccgaacagttcgctttcgaacagggattcggtgatggcacccatgtccactgttatcatatcccgccggtatcggttggacaaggcgtgtatttcccgcgccagcatttcttttcctgtgccgttctctcctgtaatcagaatattggcatccgtttgcgccactttctctatcagcgtccgcagttgcttcatggcattgctttctccccaatacatagaagatacggttttagggacttctgccctcttcttgttctttgaggaattgcggcaggcagacagcaaggtttctatcaaccgggtattgtcccagggtttgacgatgaagtctgtcgccccttccttgatgccgcgcactgccaagtctatgtcagcgtatgctgtgaaaagtactacgggcagggaggggtgtattttctttatctcgtgtaaccagtacagaccttcattcccggtattcagtccgctgctgaaattcatatccagcagcaccacttgcgcattttcttcacgtaacgcagcgggcagtgtgatgggtgagggcagtgtgacgatatgttcgaaatgatttttcagcaatagctttactgccgacagcactcctttgttatcatctaccacaatgatggttccttgtttgctcataagtcgttgtagcttctttttcctttaaagatatctttagttgtgcgtttcatgcaaaggtactatctcttcacacactctcatttccattcctttatagaccactactattttgtgtagctgtgtggtgcccacagcattcttcacccggtaggaatcagcataacgatttgcctgagcgatcccttccagcctcagttcttccacacggctctcagagtctttgtatttggcatatttcaactctatgatataactgtgcttcatatccggatagatttccagcaaaggacacaggaaaagatcagcgtatccttcttgtgtatccgcttcggaaataggacggtagaagcggttttgcgctgtcatggccagtgtgaatccatgtacgaaaaactctcctttctgtttgtcgcgttgtgaggcgtagcgtttcagacagtcggctatgtaaccgaagtaggcctgccagtctccccgataagcaagtttactggctaattcgtctttctcgtaactgctgaaactaaggtcggcctcattgtatgtattcagcaaataggtgtatagttgctcttccactacctgattgggaatggtgagtttgtttttcccttcgtgcattccgctgatggtaagcataccgaaataatagagcagactcacgaatttgtccggatcgacaatattcgcagccgaaaagctatccttcagttctccggtgatatatccttgacttaccagggtttgtatgatggaggcatcatgagcaaactccttgtccttgcgaatcagcatccggagtttttcgtagtctatgcgtatgttgctttctatcattttctgtggtgctttgccacgcagaatatagttcttgacaaaatagagaaccatgttggaattgtacagggtagtttctccgtagcattccggtgcgaagcagtagttgtcataccacggcttcatgatatctatcagttggccgacggtatggttgaacggactgtttgtggaataatacgtcagcatctcacgcacctccttttccgtgaaccctgtcatttcgttgaactccggtgagagggagtaattggtacctatattgaatccgctggtgagatcatccatggttacggggcttactccggtaatgaagcaacgcttgatgcaggaatcagttccggctttcactttgttgaagaatgcgcgcaggtaaccctctttgtgtgtctcttcagtgtatcggtgcaggctttcggcatcggagagaatggcattggtaaagtggtcatactcatcgataaaaagataaattttctgctcagtcttgttgcactccgtaaacagatattccaattgttctaccgctcctgatttttcatccagcttcttcttgataccttgtgggagatagtcggcatagatatcgcagaaatagtcgaacatggtctggcaatgtgcgtccagcccttgacggtagttgtgcaattccccgctgataccggaaaaattgagtttcagcaccagataggtgttgcggtcaggcgtggggtgctttcctatgtagaggtctccgaacagggcgtcaaacttatcgcgggtgcgtacatcataataatgttgcagcatgctcaaggtcagacttttgccaaatcgccggggacggatgaagaagaaaaaccggtccgactgttctatcagtgggatgaaggcggttttgtccacataataataattgtcgaaacggatgtctgcaaagttcatcataccgtatggcaatcgtttcctgtttgaaggtgcatattccattagttatattgtttttttatgaataaactctggtaaaagagatatgtatagcatacaaagatactttcttttccctgcttctccaaaaaacaaaggttctttctttttggtaacatggaggaagctgtccgataggtatccgccaatcttttctttcagagaaaacttttcaatttcatgaattgttctattataaaatagcatttcaaatgaaaacatttatattaagcataattgtaaccatgattacatcggtagctggtgcacagcaaaaaagtttttatgactttacggtcaagactattgacgggaaggacttgccactttccacgttcaagggtaagaaagtattggtagtcaatgtggcatctaaatgcggtttcactccccaatacgccaagttggaggagttgtatgagaaatatggaaaagatgattttgtcgttatcggatttcctgccaataatttcctgcatcaggaacccggaacgaatgaagaaatcaaggagttttgtacgttgaattatggagtgacttttcctatgatggctaaaatatctgtaaaggggaaagatatagctcccctctatcaatggcttacgcataaaagtgaaaacggggtttcggatgctaagatagggtggaactttcataagtttctgattgatgaaaatggtagatgggttgcctcaatcggctctactaccagtccgctttcacaggaaattgtaggatggattgaagaataaaatgaccagaagataaataatgccctattgttattgcaccagctttccgtttttcagttccgacatcagcaggtcatagacgtatgccgggctttcgatatacaggccggtggagaagtcttccagtttgacgaatgtctccgaattgtggaatgtggagatggcttcctgcaaatccatatcattacgttccaccaagtaacggactacatcggcggatattccttcaaagaggaattttgcggtattcgtgttcatagtcgtttcagcattttaatcgctgcctctgagtgaaagaaatattgtgaagtcactttcgaaaatgtcagttcgtgcaatagttgttcttcgttaataaaattctcggtgtataaacgtagcaagcgcgcaatggtatcatcggcaacagggccaattacgatatcgtaatcgtggcaaggctgagtagtgtttatatcgcggttcgacatgacaaaacgtgcccattcccagtctggctccttgaaaaccttgactttcaattcgctcgactgcgcttcttcgaggtcaaactcaaacatagtcagagtggggtttccgctgaacatccgcgctgttcttgcggccatcctttgggcctgttccctaatgtcggtcaggtaaaatcctctgccgaaatccttataggggcggcatctgttgaggtcgatgccgtcgattgccgtatttgaaccgtggtaaagtatcatcgcaatgttcctccattgttttggcagacgatggtcaggtcatccacacagtcgttaaaagaaagtgtgtgttccacatcgtaaaattcggtgagaaaatcaatgcctttgaaacgtctgatataattgcttgcctcccggattgtcaaatcgtgacggcgcgcaaattcgacaatgaccgtcatcacataatcgattaggttcttgtccgctttctttttggacttgagcgccactatcggttcgacacccaacgcctccgctatgcggttgacagtgccaaaattaacacacagaccgttttccactttggaaaccattgctttttggacgccaatcatcaccccgacttcttcttgtgtcaatcctttgttttttcggcattgggccaaaagttctcctattttttgcaaattcgtattcataccacaaaaatagataaagtttcttgtgtgggaaactttttaactacaaatatattctttagataattattatctttccaattaaatggcagctctgctctgacacgcaagaacccgtgtgccggatgatgattgttaggaaaacaggagggaaatcagttcctttgtacatcataggttatggaacggtggttcgaaaagagttgtcgctatttttttgcttatttatttgtggggataaatatttatccctatattgtattagtaaaattaaaaatatcatggagaatgattattaaaactgaaagttatggatacaataaaagacatttggtttgatgctaaccgcatttatatgaaaacggatggtggagaaactttcagccgtcccttagaggcattccctttgctgaaggatgcaagtgacagagagcgccttgatttcaagataggaaagtttggtgacgatgttcgttgggaatcattggatgaggatattcatatatccagttttttcgatacagcggagccggattatgaaaatgagatagcaatgatatttaaacgtttccctcaactaaatgtgtcagaggttgcacgtagtatgggaataaacaagagtcttctttccaagtatatctatggtattaaaaagccgagtgatataaggaagatgcagattaaagaggctctccatcttttgggaaaagaattacttgccgtttgattaatctcttaataatagtttaggtgtgattccatttggtttcacgccttttttatgttaatttttccacaatcatagtttcaacagaaagataattaaatataaggaagatatggctagaataaacaaatacggctatgttgctgcgtgacgtttttgcatccgtcagggagatgcggtgaacaagccaaactcataccaagaaccgggcaagcatatgatgcaggcagggtaggcgtgtaccgagtaccaggtagccttgtttgctgtatcttatatcttaccatctgggcgatgatgcgtccggaagaatttgcatcaaggtaagtataccgataatctgtttcttgtttgttttttgagtaatcaagaaacatcactaaaaatagcggaatatattttcgtcctatttattaaattgctatctttgtcacgttttccacgccggtacttccgcaaggaagttagggaggtgggaaatatacatatatagaaaagacgtttacttgacgttttgttcttgacgcttcgaaaatttgcaccttttgaaattgctgtcagagacaaagcaacagtggatgtctgcggggtatgtttatatccttggtgcgcttttgttggtcaaaggtgtattcaagtgttgttatacatatcggcgtgggcttctgcgttgctcgttcagacagcaatgggcagtgcaaagccttcgaagtgtgggacgagtaacaggtacagattcccgcgctttttttatatataggtattacaaatttctgatttaacatatatgaaccgtccggttcgggaatctgcggaaggttatcggttgacccgacaggctgcatctacatcgtgcggatttccatcctccatttgttgaaatagcttttccagtcaacttaatcacaagaggccgattcctcttgtattttacgaaacttctcgtaattgattgaattgcagatagatatctgtgcttcaaagctccataactatgctttcaagtgaaaaaatgcaatggtttgccatgcgtgccacttatcgccgggggatgcagatcaaggctttgttggataaagaaggaatcaacaatttcattcccatgcgttacgaagttcgtataaggaacgggcgcaagaggcgtgagctggttcccgttatcagtgatctgatatttgttcattccgtccagtccgaacttcagaaggtgaagttcaaacttccgtattttcaatatatgattgatatccgcaacgggcagaaaatcattgtgcccgatgatcagatgaggcagtttatcgctgtggctggaacgtatgacgagcatcttatttttttcagtcccgacgaggtgaacttacggcgcggtacgaaagtccgcatcacaggtggtgatttcgagggctacgagggggtatttgtaaaggtaaaaggtgctagagaccgtcgtgtggttatcagtctgcaaggggtgatagccatggccatggcgacgctttcgccggacttgatagaagtgatagaagagccgaagaagaaataacttcatttgctacgttaaacattgttattccctgattaacgggaaagtgaacgatctgataatataaatcttatatataaatgtgtagaaccacatccatgccgtcaggcatccggctccagcagttgattcagaatcggtataaggaaattttagccagggaaaagaataatgataaattcattcatctgtatgacattggcgcgtattgggtggctttcgagcgttccgcctgtaggttgagcggtttgttttctaaaagtgagctgactttgtttcgtgtcccggattgtgtggaatatgtggtgatggtttctgttcctgccgatgaggcggagggctgtttgggtgagtacattattttgcacgatggaatttaccggaaagtgtggtcggagcatgttttgccgatgggggattatcgtcattggcatgagatggctgtgaggtctgttttgttgtaaagaaaagtatgcggacttcgtggaccaagtaagtggtgttactttgcttacgaagatatcttacttttttcaatggaatatggtcatccgtcatgctctatagggaataccctgaaaaatccttcaaaagcttcagcctgctcgcaaacgccctacccgtgggcattccggctgaaggattgggctcaggaatccttcagctgggggttggaatgtttcagccgaactgatcttcctccgattcttagggaatcgtttttcctgaaggatattttccggctgaaacatttcacaatgcatatccttcagccggaatgccgacaggcagggtgtttgcggagtggctgaaagatctgaaggaaaaaaaaggcgtttcggcatgtagataccgttatgaaaaaaacaacaggtcaaatttttaaaagctcttgttctttcaatgaaaacgtcctgttctttttttaaagaccttgttcttttcggaaaagaacaggatcttttaagggttagtaacgtgtatgccggaaggttggtaacgtgccaccccacacgttactaatgtgtggggtgtaagattagtaatgttgcaggtggaagattgcatatcttgctagtgatacaatcataaacgtatgaagttccagtatataaaagataaagttagtgcttatttcactaaggggaatgagcgtagtgttgcggtgaagaaaaatatcgccgtttcattagtgttgaaatgtataagtattttagtttccttgcaggtcgttccattgaccatcggttatgttaatcctacgaagtatggcatttggctgacgttgagttccattattgcctggctgtcttattttgatttggggtttgcccacggatttcgtaatcgttttgctgaggcaaaagcaaaaggggatatgaagttggcaaaagaatatgtcagtactacatatgcagtgctcttcttgctcttttccgtaattttattgataaccttggtggtgaataattatttggattggagtcgtattttaaatattgatcctgtttataaggatgagctgagtctggttttcggtttgttggcatgcttcttttgcctgaacattgtggcaagtgtctttactaccatgctgacggcagatcaaaagcctgctttagcttcgtttataagtacaagtggtcaggtactggcttttgcttgtgtctatgtattgactaaaaccacaaagggaagtctgagtgctttggctgtttctttttcagctataccgtgcctgtttcttttaattgtttctattattgtgtatcaaactaaaaaatacaagattgtagccccttcgttgcgtgacgttcgcttttcgttggtgcggagtgttgttggtctgggtggacagttttttgttgttatgttttctatgctttttatttttcaacttactaatatcattttgtcaagagtgcaaggcccagaagcagttacgcaatataatattgcttataagtattttaatgtacttaacatggctgcaaatattattttgactccgttttggtcagcatttactgatgcttatattaagagagattataattggatgcgtggtacgctagaaaaactggagaaattatggttgttatgtattcctattttagttttaatggtactgagttctgatctcttatataaattttggattggtgattctgtagctgtatctttttcattatcattttgtatggcaatatatgtattatgtcagacgggaggaaatatgtatatgtttcttattaatggaacgagcaaaatacgtttgcaactaatcatttatttgtcatttgctttggtttctattccgttgatgaagtattgttgtaagtattatggtatagaaggtatactgatagttcctactacggtatttattttgcaggcctttattggaagagtgcagatattgaagatgataaatggtacggctaaaggaatttggctgaagtgaaatgaaaaacaatatgaattatcccctaatttctgtcataactgtttcttataatgcagttttaacaattgaacaaaccattctttccgtcattaaccaaacttatctgaatattgagtatatcatcattgacggtggaagtacggatggaacggttaatgtaataaaaaagtatgcggataaaatcgcttattgggtgagtgagtcggataagggaatttatgatgcgatgaataaaggaattgcttattcgcatggagaatattgtaattttatcaatgcaggtgataaattttgttcctcatctatattgaaacaggtcatggactttaatcatgtggcagatataatagttggtcaggatttacatgttaatgaacataataaaatagtatcacgcagtgtattacctcgaagatataatcttctgcatttttatataactaccatacctcatcaaagttgctttataagggcctctttattaaaaaagtattattatgatacatctttaaaaatagtatcagactggaaattctatttacaatcaatcgttttaggtgggcatagtgtggctgcgtataacaatgttattgtgatatgtaatcccagaggagccagcagtgataacaaccggataaaagaagaacgcgaaaaagtgcttaaagatctactcccagcttatattgtcaatgattatcagtgtttatcctgtttgggagaagaatttattgaaaacgctctttttttatttaataatcattggataagatttttagtaaaaaaggggcttgcaataatggttaaaatagtaagaatatttaaatagtttatttatgaaaatagtagtgttcaaaggaggactgggtaatcaactctttcagtatgcattttataaatacctttcaagaaaggatgaaaccttttatttctacaatgatgcttggtataatgtgagccataatggatttgaattagataaatattttaaaactgatgatttgaaaaaatgtagtaggttttggataattctgtttaaaaccattttatcaaaattataccattggaaaatatatgtagtaggttctgtagagtatcaatatcctaatcatttgtttcaagctggatattttttagacaaaaagtattatgacgaaaatactattgattttaaacatcttcttttgtcggaaaagaaccaatcattgctgaaggatattcaaaactcaaatagtgttggcgtgcatataagaagaggtgactacatgaccaaacaaaatttggttatatttggaaatatttgtacgcagaaatattatcatgatgccataagaataataacagagaaagtaaatgatgctgtcttctatgttttttctgatgatattagctgggtacaaactcatttggatatacccaatgctgtttatgtgaattggaatacaggagaatccagcatctatgacatgtatttgatgtcttcctgcaaatacaacattatagccaatagtacttttagttattgggcggcacgattaaataaaaaaactaatatggtgatttatccctcaaagtggtataatacatttactcctgatatttttcctgaatcatggtgtggaatctaaaaaatggatagatgataattactcagcttatttttctgctctttattattttttttataagatataaaaagaaggctgttctttatataataccattgtctttgttttttacaatgcttcctgttgtaagaatagggggtacgtatattggtctttgtgatgcgataaattttgttatatacgggtatattcttggtcggaaagatgcaaggaaagctatattctgcaatccattgtttttacctttgtttggtaattttatattgttgttattaattgctttgtatggaacggaacggacttcattgtatgtgttgtggaaaacaatatcaaatgaaatacttttgccacttgcatttatctattttttgcgaacaaagaacgatattaaattaattgtaaatctttatttgaaagtgttttgggtgttatgtatatatggaattatagagtttctattaaattataatataattctatattggctgcaatctcagactgatttgtctttttgggtagatcataccaatgatatccgatatggatatgggcgatataattcattttttcattttcccataacatttggagatgcgtgcgttgtattcttttattttcttaccttcttctatagtaaatatgaaggagtatttatatcaaggaaatcttatattaagactttgtgtttgcttcttatcggtgttttccttgctaattcacgtgccactattcttgcattagtatttggattgttgcaatttgactatataagaaagcctaaaactctattaatcgctttttctatctttttaatcatggtcttgccgttttctgattatatattaaatgtatatcattccatatttgattttacgggtaattatgatgttggtggaagctctatggatatgagaatgagacaattagatatttctctttttctgtttttacaaaaccctatatttggtggtggcttgagtatgatttattatttaatgacagatatatcaatcccggaacttgcaggtgcggagtctcaattattttatttgttgattgaacgtggtttgttaggtatattgggatatctatggctgataatttcaatgtgcaaattattgccttcatatagaaagttcaacatggtttttgttggtatctgggtattggcttctttcgtatcattaacagtgggattatatataaattttccgattatatttttgctcattatatataagagtcagaaacttaatttattaaaaagataatgttctctattattattcctctatataacaaggctgattatattgcagaaacactgaagtcagttctgaatcaaacatattgtgattatgaagtaatcgtggtgaatgattcatcgacagataatagtttggaagtggcttctagttttcaggatgaacgaattcatatttatacaaaagaaaacgaaggtgtatcagcagcacgtaactatggtattatgcatgctaaatatgattatattgcttttctggatgcagatgatatttgggaatctgattatttggaatgccaaaagaagttgataggaacctatcctgatgctgggatttattctactgctttctactctttggaaaaggggaaacggaaacttcgtaatgtgttgattaacgaacacatacacttccttgttcatgattattttaaagaatccgtaatgaatggattatctatttgctggactagctccttgtgcttaaaaaaagaagtgataaaggagataccaatgtttcgagtaggtattaagcgtggtgaggatttggacctttggcttagaatagcgttgaattatgatgtagcctatttgaaccttccgaaagtcttttatagaacagggttatctgatagtcttacatcagattattctaaaaatggagaatttccttattacgagtggtttaactttacatcggaaagttcttattatagaaagtatgtgattttagttgtgtatatacatgcaaaaaatgcatttatacatcatgattacgatacatgtttggccgagttgtggagtgttaaaactattgcttggagattcaaatgggcagagcgattattattactagtaatttcatggataaaaagtaaataatgaatatcatttattttgttcccaatattaccattgcaggaggtatattccgtatagtgtcagacaagatgaattatttggcggaaaatatggaaggacggctttttttggcatattatggtaatggacaggaaaaacctatatatcctttgcacccgaacattcaactgttacctattgatatagagtggaaggtaggctttggaaagaaaattaatagagtatggaaaaatataagtattatacgtcacatatttaaaaaatataagatagatattgctgtcaatgccaatgctcctttattgatatggatattaccatttatttgtcggcggataaagaagatccatgagtttcatttttcttataaaggacaacagatattagatgaggaaatttttaaatcgcgaggaaagaaatttttagttcaatatttaagaaagtgttgtttgacaaaattcgataaggtaattgcattaacagagtctgacaagaaaatgtggaatttaccgaatatatttgtaatacctaattttagcaatatacaactacatgaaagaaatggtagaaaaagcaaagttgctatatcagcaggtagattagaatctgtaaaaggttataatcgattgattgcagcttgggtgatagttgcacaaaagtgtccggactggcaattggaaatttggggtgaaggaagtctgcgagaaagtcttcaacgacaaattgatgctttgcatctttcatcagttgttcatctgaaaggtgtttcacctagtataggtgaagtatattctcattcttctttttttgtcatgtcatctttgtatgaaggtttcccgttggtattggtggaggcgatgaattgtggcttgccttgtgttagttttgacattactggagcaaatagtatcatagacaatggtaagaatggatttttagtgccggataatgatgtaaatgccttggcggaagcttgtataaaattgatagaaaataaagtattactagaagatatgggtaagcaggcttatatgtcgggaaaatgcttttcaaaaccaaaggtaatgcaaaaatggttagacctgtttagggaactgatgagagaataaaccgcatgattggaaagaaatataactacatacaaattagtttactattaatatgttagaaaagaaaattgcattgttgacttctgttacatttaataatattggtaacggatttatagatttgggtgctgaagctgctttgatgaaagcattaccgcttaatgctgaattatttaaagttagctcaaatgctaattttgcagctacaatgggacaaatgttcatgctgaaagaaaacccaataataaattggttatgggtacataccatgcaaagggctgctaaaaagcttcatgaccgttcatacaaaacggtaaaaacgcaaaatatctttagtatggccagtatggttaaatgtgattattttataattccgggatgtgtattaactgttccattttttacgatttatggagatttaataaagagaaaagcagaacaaggaagtaagattatttttttaggtgcaagcggaaacttctatacagaatatgaagtcaaatttgtttctgaatatttaagaaaattgcagccttacgctataatgacccgtgatagccttgcctataagtactatgcaaattttacaaaaaatagttataatggaatagataatgtgttctttgtgaatttacttaatttaccccaaatagatactgatttaacaccgtatgtagtattgaatattgaagaacctaagcattataggataaaagaagaactgaaaaatatttttaaagaaaagaatattgtttattcttatcataagccttttccttatacaaaagttagtaagttagtaaaaaatggagtgatagtatctgataatccaatggattatttactcctttaccggaatgcttcagaagtttattctgatagagtacatgcttgtatccctactttggcatttggaaataaagcaagattgtttagcaatagtcctaggatagccttgtttgaaaatgcgaaaattcctgatgtaagggaaagacttgtcagcatagaaggattaaaagaaatgcaggacaaacaaattgcatttctagcttcattattacagtaataaagagaatggtaatatgaatatattgtttttttatcgtgtttatcctaattatggtggtgttgaggtagtgacaactgtacttgccaatcgttttataaaggatggacatggtgttatcatagcttcaatagaacaaccgcatattgaactagcttgtcaattactaccagatgtaaagcttgtcaaattagactatcctgtttgttctataaaaaatatgaggaagttacatcgattaattataaatgaaaaaattgatattataattaatcagtggggacttccttttatgtcaacattgctgtgtagagtggctataaaaagaacatcatgtaaattgatttcggtattacatggcgctccaaatacgtctaaattaattattaaggcacgtgataaatgtgaaacagtttataacccttttttgaaatacatatatcatgctataatgtatctaaaagaagagttggtaaaagctagcattcgttataattgtagccattgtgaaaaatatgttcttctttcatctcattttatcaagccgttaagtgattatgcacatataaagagaactgagaatattatagcaataggcaatcctgttactattcctgtgtattttgaagaatgggagttaaaacagaagaagaagcagctgttatatgtaggaagaatggattatgaaaataaacgagtaaatagaatagtggaagcttggaaagttctttatgaaaaatatgttgattgggaacttgttttggtgggagaaggcccttataaaagtacattggaagaatatattagaagatatgatattcaacgtgtttgtttcaaaggctttcaagtatctcctcccatacaacattataaggaagcttctatatttttattgacttctgatttagaagggtttggattagtagttattgaaagtatgagttatggagtggtcccagttgtgtatggaagttatgaagctatatatgacatcatagacaatggaaagtctggcttaataactccgataccttataatagtcaaaaaacaattgactgcatcagcttgctaatcgagaatgaaaaattaagaaaagaaatggcaaaggaagccatgtgtaaggcgaaatgttttacaattgattctgttattacaaggtggtataatctgtttgaagaagtattataaacttccataaaaataaattatcatttaatttatgctccctctattgcttaataaaatcatacaaacagataaattgctgtttttacatttggttactcagaaaaacagaatttacacctttctcaaccccgtatcttatctcatagctttagaaaacaaatctttatttgaacaattcgatggtatttttgccgatggctctttactggtttctgccataagattagtatacggaaagcgagtgaccagacgtagctttgatatgacctcccttgctcccgaattgttgaattatctcatggaaagccgtaaaacgctctatatcgtagcctcgggtcaagaacaagtggagtgttctgtgaggatatttcaagagcagtatccggagttacgcattgcagggttcaggaacggatatttctcttcggatgctgaaatgaataaggaagcttctcatatagtcgaattaaatccggattttctgatagtaggtatgggggccttgatgcaggaaaagtttctgcttaaggtaaaaaagatgggttaccaaggcatcggctttacgtgtggtggctttgttcaccaaacggcaatgaataggatgcactattatccgaactgggttgataagatgaatttgcgtttcgtttatagaatgtataaagagaaacatacacgtacaagatatctgcaagctgcattcttgtttccggtacgctttatcggggaaagaattttcggatgaaagagcagactttgcttattgccatgtaaataatggagaatggcaacaacaggacgaagatagcagtaggaataatttttccgagtatttttaatacatctgttttcatgctgcaaatataaattaaaattcatagaatagtgaaattaagaactctaatatttctggggggactctttggaggaatgaatgttatcaaagggcaggctttttatggtactacaggactacttcatgcacctactgccgttatgcagaaagataaaaccgttatgctgggaggaaatatgctggatgtaaatatactttcccgatattgggtgagaagtgaatatcatccctatacctataactattatataaattgtactttgtttccttggctggaagtagcatatacttgtacgttggtaaaggggatacatggttcttcttattggcctcagcaaacttggggcaggtttaccaatcaggacagatcgtttcatttccggttgagggcatggaaagaaggctggtggaaggcttggacgcctcaggtagtgattggtgcgaatgatccgggaagccattcttcaaatggaggtggagacatagattgggggggcggtggtagcggaaaccacaattacttgacacgttattatctggcggcaacgaaacatgttgaatttagtggaataggtacagtgggggttcatgtagcttgggttatcggtaaagctatgagtgatgtgcattatagccgtcctgctgcaggggtaaactttcattttggcatgaagggcgaaggtttctggcagaaagctctgaatggatttaatctgatggcggaagtgtgtcccggacatgcggaagatctgcatacagcaacttatactgtgaatgtgggtggaacttattcaatatggaaagaccatatcaatcttattgctgaactgaataacggtaaattttttagcggaggtatattctttaaattacatcttaaataactgacttgatttctagtggatgaagcattataagaatagccggaatcacttggaaaaagtagttccggctattcttatataacgatatttgtatgtcctgtttttattatcctacaatgtatttagcattcttgccgcttattttacgaatgaataccacaagcagccacgatacgccaaacgccacgattgcggcagcgggaatttgtaaaggcacgggaacaccgatattgcgcatcaggactacacccggacctgtgaaaaaataatgtatcatatagatgccaaaaccacatacggtcaagtttgccagcatacgctggatcagttctgagcgtacttttactttcttggctatgaggaagaaggggatagtcatcataatcacattcaaagaattataggtgaagaacagttctaacatttcatcagtgcattgtggtaatgcggtcatgtggcggaaaccgaagaatgtgaccatgtaacctgccagaaacatggggatacagactgacagtgtcttactccatgaccagtcgtggttgcgcagatagtgtcccaatagcaagtacccgttgaatccggcaaaataatagaacatattgaatgagttccacgcacagcctccccaaatgtatggggatacgaactgataataataaggtaacaaaccagttattccccatgcgacaagaaaccatagtttggctttctccgaggccttttctacccatgcggagaaaataggaaggtatagatataatccgataagcagatagatataccacatatgtacgtctaataaagagaaattgagaggcatttctgctatataacccaatgatacgttgagtgactgacgggcggcttcttcaccgctataagggaaaaagtcaaggattatttcaggattaagtcccaacaatcctgtaaaccagggaaataaattataaatgacactccagataaggaacggccagaatacacggctgattctttttttgtagaaagcggatatttcgccacgtacggggagcagcaatgctcctgtaatcatgacaaacagtgggacacacggacggagaaaggctccgtaggcggctccccagaatttgatttcatcaatgttggctggcggttcgccggggtaaaagttgaacgggtctgcactatggcagcaaactatggtgaacatggctaccaaacgaacgacatccagccataccacatgttttcttgtggtgtttatagcaataggttgattcataatttaatttttgatttgacaggcacaaaggtacgctttctctgaggattatttcttgctttggaacaaaaaataaaaagaactatccgcaatcatactacaaaatgagaatcctcccactgcaagagtcacaatcatttgtcttttgcagggggaggaattctatttagggttagagggttattttagtcctctgttcttcaacaagggatcaataccaggttctttgccacggaaattgacatacatgtccattgcatcgtcaatgcagccgggagtgaggatatatttgcggaactttcctgctacttcttgattaaagatatcgcctgtttccttgtatgcctcgtatgcgtcacaatccagcacttctgcccaaatataactatagtaaccggcagtatatccaccacccatggtgtggttgaaataagtggtgcgatagcgtgacggaatttgtttcagcaatccgcgcttacctaatgtttctgcttcgaactgcataacgtccatatcatcgggaatttcttttaatacatgataatccatatccagcagggaagcagctaaatattcagccgtagcgaagccttgtccgtatttgccactcttgtccattttttcaaccagtccggcaggaataacttcatctgtctgataatgtttggcatatacattcaatacctccggttcaaaagcccaatgctcatctatctgtgacggcagttctacaaaatcacgcggaacactagccacaccataataatgtacatctttgaaaagattatgtaaagcgtgtccgaattcgtggaacaaggtattcgcttcgtctgcactgagcaaagcgggttgtccggctgccggtttggtaaagttgcataccacggttactacaggagccactttcttgccgtccttgtaggtctgtgaacgatagcttccgcaccatgcgccacctttcttgctggcacgcggaaagaagtccatatagagtacacctagatgagaaccgtctttgtccttacattcgaatgcctgtgcatcgggatgagggaggggaagattgtccagctgggtgaaagtgataccgtacagtttgttggcaacatagaacacaccgtcacgtacgttttccagtttcagataaggacgtacctgattttcatccaagtcgaatttggctttcttggctcggtctgcataataacgccagtcccaaccttcagctgtgaaggtttttccgtctttctttatttcggcattgatatctgccagttcttctttggctttggacagagtaggtgtccaaatctgatctaataatttatatacggcatccggtgtttttgccatacgttcttccagtgcaaaggaagcatagttttcatatcccatcagcttggctttttccagacgggccttgagcagtttgcgcaccacttccttgttgtcgtattcatttccgttatttcctctgttaatgtatcctttgaatatcttttcgcgcaggtctcggttatcggcatattgcagaaaaggcatgacgctgggattatgcagggtgaaaatccatttgccttccatgcctgcttctttagctgtttcggcagcactggcaatcaggttttggggtaatccggctaagtcttcttctttgtccacgatcaattggaaagcattggtttccttctgcatattttggccgaaggtgagctgtaacatggaaatctcactatttaattcacgcagttttttttgactttcggcatccaggttggcacctccacgtacaaaatctttataggtttcttccaacaacttcttttgctctttgtccaaatcgccgggattttcatagacagctttgatgcgtgcaaaaagtttttcatttaaggcgatgtcatcactgtgttttgattgtagtggagagagttcacggctcagtgcgtccatttcatcattggtattggcgcttttcagtccgtagaatacggtgctgactttacgaagtaacgctccgctttgatccagtgctgcaatggtattctggaaagtggcgggttcggggttgttcactatagcgtcaatctctttctgttgttcttccatgccctgcaaaaaggcgggtttgtaatgttccatcttgatttggtcgaaaggaggaacctggaagggagttgtgtactctgaaaggaatggattttcggtaggggctgcctgtttcccttgcgaaccgcaaccgcttaatatggcaaccgcacaggctgccaaaagaatgtgtttcataataatttgttttatataggtgataatgcaaagatagtaaaataaggcaaattccaataagtttgaagcgtagaactatttgtttgttttcatagtctgtctaattatcatacatcattgtctaataattagacagactgtttctttttgttattttgcaatgtgttgttaatcagttgtttgtttgcgtggcacggttttggcatttatattatagagaacgaattatagaaactttagtttcttatacactttatgggaagtaacgttgtgaaacgggacttctctcttttaaaataataataattaaaaacacgaaatatgaaacagatttattatgtcattcaggctttgatacatggatgtggagctaatattataaaagtcgtttcgttaggcttgggcctgactatgagtattctgcttttctcaagagttgtgtatgagcagagttttgatacttgttttaaggatcatgataaattataccaattgtggaatatatggacagtaaatggagagccttttcctccgagtgagttcattatcggtgcagctgccggaggcatactggatgcaatgccggaaattgtggaatcggcggcaagtacaggctcgtggccggtttcggcacctatttataacgggagtgtccgctttgatgattttaaagttgctgctgattcattgttttttcagacaatgggtattgaggtcttgagtggtgatccggtacgtgaattgcagcaaaaagatgtaattttcctgagtaaagatttggcggataaaatgtttggcggtgagaacccgattggtaaaataattagtttcaataaggaaattgagttgacagtcaaaggaacgtatgctgctttacctgagaattgtactatgcgaccgaaggctgtcatttccttgccttctatctggagccgccggataggaaattattcatggaacggtggggacagctggaaagaatatatccggttgaagcaggatattgatttggatgaattgaacaagcgtattgatatggtagtacagcaacatattcccagaagtgataagttgggaatcactgtcatggcaaaacctgttcgggatacgtaccgtggatatgatgaagtgaaaagaatgcgtaatattatgcttattttaggtatatctattttgtttatcacgacattgaattatgtgttgatttctatttcttcattgagccggcgtgccaaaagtattggtgttcataaatgcagcggagcgggaacgggtactgtttttggtatgtttatgtgggaaaccggtattattattttgctttcattgtttttgatggtttttttaatgtttaatttccgggaatttgtggaagatactacagctgctaaactggagtctctttttgcggtggaacgtatttgggtgccttttggagtgactgctgtcttattcctcattggtggtgtgctgccgggacgaattttttcaaagataccggtcacacaggttttccggcgttatacagagggtaagaaaggatggaaacgtccgttattgtttatccaatttgcaggagtggcttttatatgtggattgatgtgtgtagtgatgctccagtatcattatgttattaataaagatccgggttataatcctgagcgggtagtgattggcgttaataatgcaccggatgctaaagcccggcttgctgcccgtcacttttatgaggggcttccatacgtggaagcattgacttcggcaactagctatccgtctaatggatatagcgggcagatgataccggatgagaaaggaacgagtcttttttccagccgttatgattttactcaggagaattatgtagcttttatgggaatggtcatacagcaagggcgtgtgcctcgtgaatccggtgaggtggcagtgaatgaggaatttgtacggagaatgcattggggaaaagatgttttaggtaagagtatacagacagaagaaggccgtgtcaaaatagtaggtgtgattaaagattttaatattggcggattctactcagagctgaaaccgtttgtcttgcatcatcatcccaaagatttggctgatcttgtttatctccgtctgaaggaaccctttggtgagaatcttcagaaactgaagcgtgatgctgccgaagcttttcctaatcaaacagtcggctttgaaagcttggaacaaaaaatggcggatagttataattccgttcgtgtatttcgtaatgcgactttattggcggcaattgccattttgtttattactttgatgggactgataggctatattaatgatgaattacagcgacgttcgaaagaaattgctattcgtaaagtgaatggagctgagtcatttgcgatattggaaatgttggtgcaagatgttctttggatttctttcccggctgtagtcgcaggtacactaggggcatggtatgtaggtggtttatggatggaacagtttgctgtgactgtaggttcgcttgttccttattatgtatgtgtagctatcgtggtcttgatattgattgtcagttgtgtcatttccaaaacatggcgcattgccaatgagaatccagtaaagagtattaaatcagaataaagatcaatagaacaaacaattaaaatttattattatgatacagattgaaaatttaagtaaggtatttcgtacttcagaagtagaaacaattgcgttgaatcatgtaaacatagaggtgaaagaaggagagtttgtagctattatgggaccatcaggttgtggaaaatccaccttattgaatatccttggtctgctggacaatcctactgaaggcagttacaagttgctgggcaacgaagtagccaatctgaaagaaaaagaacgcacccgcctgcgtaaaggtgtaataggttttgtatttcaaagttttaatctgatagacgaactgaatgtttttgaaaatgtggaattaccgttgacttatcttggaatcaaggccagtgaacgtaaggagcgtgttctggaaattttaaagcgaatgaacttgagtcatcgtgccaagcatttcccgcaacagctttccggcggtcaacaacagcgtgtggctattgcccgtgctgtggttactaaccctaaattgatcctcgccgatgagcctaccggtaatttggactcaaagaacggtgctgaagtaatgaatctattgaccgaacttaacaaggaggggactagtattgtcatggtaactcactctcagcatgatgccggatttgctcatcgtgtcattcatttgtttgacggtagtgtagtggcgaacattaaagaataataatgaaagggtggttgtaatgaaacaaatctattatgcaatacaatcgacattacacggccgtggaagcaatgtgacaaaagtcatatcgctttcattaggcttgactattggtgttctgcttttttcacaaatagcatttgaactcaattatgaaaaatgttaccctgatgccgaccgattggtgttggtacgtggaggaggagagaatgtaaagactggagagaaaggagaaggatatgatgatagcttgtttgctccgatggcagaagcattccgcagtgatttgtcacaatggattgaaaatgctacagtcattttcaattttgagacattaaatgtattcaaggatggtcataagctgaaagacgtaaactacgcttatgtagatacttgctatttccgtactttcggcatcaaagtattgaaagggaatcctgaggaattgcaaagggcagggagcatattcgtttctgaaacttttgttcgtgatgtctttggtggacaggatcctgtgggacaaaaattatctttggataaacagcatgaactgacagtccgtggtgtttatcaggatactccggaaaatacggcctatcattttgattttgtagctcccatttatgccggaggtggttatatagggggtggaacatgggggcgtaatgacatttattatactattctccgtttgcgcgatggggtggacagggaagaaatcaatcgtcagatatacaaggctatgcaaaaatattatcctgattctgctgatgatgaatggagaaatttttatgatgcacagccattgcccgaaattcatctggatgactcaaatacccgcactcgcctttacatttatggttttttgggctttgccatattttttgtggcaatcatgaactatgtattagtagctattgctaccatgagccgcagggcaaaaagtataggtgtgcataagtgtagtggtgccagtgcaatcaatattttcagtatgttcctttttgagacggggattgtggtattgatgtccgttatagtggccctctttattattttcaataccaaagatctgatagaagatttactttcggtgcagttatcctcactctttacattggaaactttatgggttccgatgctcattgtttttgtactgttcatagtagccggagtgctgccgggaagattgttttcacgcattcctgtcactcaagtttttcgtcgttacacagatgggaaaaaggggtggaagcgttctcttttatttgtacaatttatgggggtatcttttgtgatggggattttgttagtatctttgatgcagtatcatcatctgattaatagtgatatgggtatccgtactccaggattggtggaggcggaaacatggatgtcacccgaagaagcagagaatatggttaacgatcttcgtcgtcaacccatggtggaaaatgccacccgttctatgcatggtgttctgggagaatattggactcgtgggctgattgataatagtggcaagcgaatagaaaccttgatgtataatccttgtgataagaattatgctgaaaccatggggattactattattgaagggaaagatatgcagaatgagggagatgtattggtcaacgaagaagtagtgcggctgatgaaatggacagatggggcagtaggcaaacggttgaatgattttgataaagccggaaccattgttggtgtattccgtaatgtgcgcaatacgtcttttctttataagcagtttcccgtggctttggtttatagtcataataccagtcacacttttgatgtacgtttaaaacagccatacgatgagagtttgaaaaagctgaacgaatacatggagcaggtgcattccactaaggcattggaatttattccgatagataccatgctgaaggaaatctatcgcaatgtatatcgttttcgtaattctgtatggattacttctacttttattttgcttattgttgttatggggttgataggttacgtgaatgatgaaacacaacgtcgcagtaaggaaatagctatccgtaaggtgaatggtgctgaagcttcgactattcttcggttgctgtcccgtgatatattatatgttgctgtcccatcggtcttgatgggaattgtagtatcgtactttacaggaaaggcttggttggatcaatttgccgaaacgatagatatgaatgcgttgtattttgtcggaacagcattggtgattatcgctctgatagtggtgtgtgtcgttgttagagcttggcgtattgctaatgagaatccggtaaagagtattaaagttgagtagtgtatttggaaaaaggagagcgggatgatatgtgttgggtatcatcccgcttttttctttttacctgattcctgtgaaatttacattgacaccatccaatgtgccttttaagaagtttccggccaaccatatattttcaaaatatgaaatgtcactgggaccgtaaaccatacggatacatgtctgtgcgctgttatcccatctccattcaaaattgtatctgtcttcggttacatagccgtttcgatgttctatttgtatgatgtctgtgcctgttctattttcgtaaaagtctagtcgttgtgtgtagtattcaccgtcttgttcccaagtttcctgccaggtccggctgcatagttcccgagtggttctgtaatatatttcgctgtaatcatcatcatcgtaccaactttctatggatacttcacaggaggttaggttaaccattattatcagtacaactaccattccgaagtatttcagtatttttgttctcatatccgttaattttaaaatttgtttttcttatgtcacaaagataagtggagggaatgatacaataaacggaatattcctatttgtaaaggagagtttccctatttgtaataggaaaattcctatggtgaggagaggggaataaggtctgtcttatttcttttactattaaactgtaagttacaaaaagaggctgtccattggtgagacagccctgataatttccgaaaaatgataataggatatttctatatatttttaattatccttgtttgggtattatctgcgtttttttgaagaaagaagtggtgcttcctgtacttgcttcattactctcaagagattacctccccaaatcttccttaagtcttcttctgtatatcctttttcaatcatttttatggtcagattaattaagtcattatctcctttacatccttgcagaccaccaccgccatcaaagtctgtacctattcctacatggtctatgccggctactttaatcatgtggtccaaatgttcggcagcatcacaaacggatgcggcttttgggtttttattgatataggcatcaaggagacataactgtgccactccgccatttttcgctaaggcacggagttgttcgtctgtcagattacggtcatggtcgcataaagcctttgacgaggaatgagaggcgatgataggttgtgtactatattttatcacatcccagaaagtaccttcactggcatgtgatatgtctatcataatacctaaccggttcatttccttcactacctcacgaccaaactgtgtcaatccttgagtcgcatcttccgtatgagtggacgaatggcaaatatcgttatcataagaatggcagagagttatataattaactcccatctgtttgtatttttttatattctttaggtccttgccgatggcgtaaccattctcgatccctataaagaaagctttcttgccttcattctttaaacgtaccaaatcctcttccgtaagggcgatgccgcaaaaatctttgtattttgctacttcgtcataaatggattgaatcaatagggtggtgctttctacggctttttgtgaagatacgtcatctcgtttcccctgccatataaatgcggctaggaactgtgcgtccaatttgccttcctccattttggggatgctgaccatgttgtcttttctcaagcctacgctgtaaccgtttttaaaccaaagaggagtatctgtatgagtgtcaatggatagaatgcggctgtgaatttttttagctaggttgaatgtatcagccttgttcaccaggaatttaaataatttatgcatggtggtatctccggcagctgtaaatatttccggatgaaattgcacacctatcatttgccgtatgggataagcttctatagcttccgctatgctgtcgggtgcccaagccgtgattttgaatcccggtgccaattcccggatagcctgatgatggaatgtattgacttgcagcacttcttgtcctgtaatttctgccaacttgctttcctttatgatggatatcggatgggtgggggtagtgccggattctttttggcgatggttgacacttgaaggatgttgcgtgggcagatcttgatataaagttccaccgaaagctacattcattaattgtagccccctgcaaattcctaatatgggaatattccgatctgcggccattttcagcaccatcaagtcgaaggtatcccgggcggggcttacttcttccagtttttcataaagaaggtcgccataatacattggttggatgtcttctccacctgtaaagacaattccgtccagtcgggatacaatttgacgcagtatttctacattatccgttacaggtatcatgtaaggaattcctccagagagaatgactgactgtacatatgccgtgtttacggctgtccgtttcggacttatatctgtggaaattccaatcaagggaaacctttttattccgggaatcaattcggaatccactttttgattcaaccggacgagtgcttcggacaaaggatccttttgacttttttgtgcttgtacatggcaacatcccaaagctaacagtaatactaagaggcatttgtttttcatatgaatatagattttgtcttgcaggcaaatgtataaactatgtttttattgaaaaaataaaatgccataaaaatagagtaggaggtacttattccaagcacctcccacctttatattcagaaaatattcaatttacttcatatcttccacagcagcctgcgccgcagccagtctggcaataggcacgcggaacggagaacaagacacatagttcaaaccaactttgtgacagaatttcactgatgaaggctcaccaccatgctcaccgcagataccgcatttcaaatcaggacgaactgaacggcctttatctacagccatttcaatcagctggcccacaccattttggtcgagtacttggaatgggtctactttcagaatcttcttttccagatataccggcaagaaagaagcaatatcgtcacgggaataaccgaatgtcatctgggtcaagtcattggtaccgaatgagaagtattctgcacggctggcaatgcggttggctgtcagcgcagcacgcggaatttcaatcatggtacctaccttgaacggaatttccataccttctttttcaaataatgctgctgctgcatcacggatcaccttttcctgagcttcgaattcatacaggataccggtcaagggaaccataatttcgggatgcggatcatatccttctttcttcagttcaattgcagcacctagaatcgcttgagtctgcatctctgtgatttcgggataggtgttacccaaacgacagccgcggtgacctaacatcggattgtgttcacacaggctttccacacgttttttgatttcctgtacggttacgcccattgccttagccatttcttcctgaccttttgcatcatggggaacgaactcatgcaaaggaggatcgagcagacgaacatttaccggacatccgtccatagccttgaagatacctttgaagtcggctttttggaaggggagcaatttagccaatgcttttctacgtccttctacatccggtgacaggatcatctcacgcatagcgacaatcttttcagcatcaaagaacatgtgttccgtacggcaaagaccgatacctgaagcaccaaaagcgcgggccacttccgcatcatgcggagtatcagcgttagtgcggacattcagcttggtgtatttgttgcaaagatccatcaatgcagcgaaatcgcctgaaacttcggctgctttggtttccactttacctttatatacttcaccggtagtaccgttcagagagatgaagtcaccttcttttaaagtaataccttcaatttctacggtacgtgtcttataatctacattgatagcaccagcacccgatacgcagcacttacccataccacgggccacaaccgcagcgtgagatgtcatgccgccacgtgcagtcaggataccttcggcaacggccatacctgccaggtcttccggcgaagtttcgatacgtaccatgaccacctttttgccatcggcagcccatttagcagcatcatcggcgaagaacacaatctgaccggtagcggcacccggagaagcgggcaaaccacgagtcaaaactttcgcttctttcaacgctttcttgtcgaacacagggtgaagcagttcgtctaatttattaggttcgcaacgctccaatgctgttttttcatcaatcattccctggcgcaacaagtccatggcgatttttaccatggcagctccggtacgtttaccgttacgggtctgcaagaaccataatttaccttcctgtacggtaaattccatatcctgcatgtcgcgatagtggttttccagtttggtctgcagggcatccagttctttgtagatttccggcatagcttcttccatagagggatatttggctacgcgttcttcttcagaaatacctgcacgttctgcccaacgctgagaaccgatttttgtgatttgttgcggggtacggataccggctacaacatcttcaccttgtgcgttgatcaaatattcgccattaaacaaatcctcaccgttacctgcgtcacgagagaagcaaacaccggtagccgaagtatcacccatgttaccgaataccatggcttgtacgcttacagcagtaccccattcggcaggaataccttccattttgcggtaaagaatggcgcgttcgttcatccagctgcggaatacagcacaaatggcaccccaaagttgttcgtatgcacaggtcggaaaatcttgtccggtctgttcttttacagcaactttaaagcgtttaaccagttctttaaggtcttccacttccaattcgttgtcgagcttcacacctttttcttcctttactttttcgataatttcctcgaaaggatcgatgtcttccttgttcaccggtttcatacccaataccacgtcaccatacatttgtacgaaacgacggtaagaatcccatgcgaaacgggggcgtccggtcttgcggctcaagccttccaccacttcgtcatttaaacctaaattaaggatggtatccatcatacccggcatagaagcgcgggcacccgaacgtacagaaaccagtaacgggttctctacatctccaaacttggaattcatcagattttcgatgttggcgatagctttctcaacatccgctttcagcagttctactactttatctttacctaactcataatattcgctacaaacttctgtggtgattgtaaatcccggaggtacgggaacaccgattagattcatttcagccaggttagcgccttttccaccaagcagatttctcatgtctgcttttccttcagcttgtccattaccaaaggtgtaaactctttttttatccataataaatgtatttaaagttaactcgctcaaaaaatgtaatcgcaaaactatacatattttagttatctccaaaccttttactgaaaaaaaatagtggaaattgcaatttctactttgcaattttaatatcttacgatttatgaggcaatattcagggaaaatgcttaaatttgtccccaaattaacttattcagaaaagtggctagaaagaagaaagaacttccattattagagaagataaccataacagatgtagctgccgaaggaaaagctttggcgaaagtgaatgacctggtagtatttgtgccttatgtagtgcccggtgatgtggtggatttacaagtgaagcgtaagaaaaatcattatgcagaagctgtggctgtgaaattccatgagtattctcctgtgcgtgcagtacccttctgccagcattatggtatatgtggtggttgtaagtggcagtgtctgccatatacagaacaaataaagtataagcaaaagcaggtgacggataatctgacccgtatcggcaagatcgaattgccggaaatttcacctatcatagggtcggaaaaaacggagttttaccgtaataagttggaatttacgttttctaacaaacgttggctgacagaggaagaggtaaaggaagatgtgaagtacgatcagatgaacgccgtaggtttccacattcccggtgcatttgacaaggtactggctatagaaaagtgctggttacaggatgatatcagcaaccagatacgcaatgcgattcgtgactatgcatacgaacacaattattctttctttaatctgcgttctcaagaaggaatgcttcgcaacttgatgatccgtacttcgagtacgggtgagcttatggtgttgctgcaatgcaagattgtggaagagagcgaaatggatctgatgaagcaactgctggctttcgtggcagaacgttttccgcagattacttccttattatatgtagtcaataacaaatgcaatgataccattaacgatctggaggtaatggtgttcaaaggcaacgatcatattttcgaggaaatggaggggttgcgcttcaagataggagcaaaatcattttatcagactaattccggacaggcgtataatctttataaggtggcccgtaattttgccggattgaccggtaaagaattggtgtatgatctttatacagggactggaaccatagccaactttgtttcacgccaggcaaagaaagtgattggtatcgaatatgtgcctgaagcaatagaagatgctaaagtgaattcggcaattaatggcattgacaataccttattttatgccggtgacatgaaggatatcctcactcaggagtttatcaaccaacatggtcgtcctgatgttattatcactgatcctccgcgtgccggaatgcacgatgatgtgattaatacaattctttttgctgaacctcagcggattgtgtatgttagctgtaatcctgccacccaggcacgtgatttgtctttgttagatgccaaatacaaggtgatggccgtgcaacccgtagatatgttccctcatacgcatcatgtggaaaatgtggtgttgctggaaaaaagaggataatccggatagttcaattataaattgtttaaacagtaaatagaattatgtcaagaggtaagaatagtgattccggcaggccaaaggcgagaagtgttgcccgatatactatatataatgtgacggagcccgctgagctgatggattttctgatgcggaaaatggcgggaatcagtcgtagcaaggtaaaggcgttgcttgccaaccgcgtgattttggtagataatgtgattactacccaatataatttcgcattgaaaccaggtatgaaagtgcagatatccaaggtgaagaataatcgtgagtttaaacatccgatgctgaaactggtatacgaggatgcttatatcttggtggtggaaaagaaggagggactgctttctgtcagcacagaacatcagaaggagcgtactgcacaacatattttgaatgagtatgtaaaacgttcacatcgtttcaaccgcgtatttgtagtacatcgtctggaccgtgaaacttcggggttgatgatgtatgccaaagatgaaaaaacccagaatactttacgtgataattggcatgatattgtgacggaccgccgttatgtgtctatcgtttctggtgatatggagaaagattacggtactgtagagtcttggttgaccgaccggaaattgtatgtctattccagtcctgtagataatggggaaggtaagtttgcggtcactcattataaaacaataaagcgggccaatggatattcattggtggagttggatttggaaacaggacgtaagaatcagattcgtgtgcatatgttggatttaggtcaccctgttgttggtgaccggcgctatggcagtgagtgtgatcctttaggacgattggcgttacatgccttcaagttatgtttctatcatccggtaacaaaagagttgatggagtttgaaactccttatcctacggcatttaaaggattaatgcagaaaaaatagaaagtttcttctgttaaaattaaatataaggcttctttgcatttattttgggcagaggttaagaataaaaaagcaatatccatccatttaccaaactgtagacggatggatattgttgtttttagagatttggcagtttcattattaaattgcctttcttaatgcaagaatggtcatgtagtccgtaagcattcggcctcgtgcgtgtttctctccaagttataataaagtcaaaagcctcacccggttgcggaaacggttgatggtgatgaaatccggtttctcatatccggcaagccagatataatggatgtcacggtgaaggagcttttcgattttccggcaggagtagatgttgttcatataggcatacagaatgaccttgagcatcatcctgggatggtaagggctgcgcccgcattccttatacaacttcctgaaactttcaagggtcaggctctcaaccagagcgtcaaccatccgaactggatcatgctctgcaatatcctcgtcaattcttggaggaaaaagcactgtttggttgggattgtaaggacgaaaatgtatctttgtcatagtataaaatgttatgcttaaagatacaaaatctttaggtaataacaaagcccctgcttgtgaaagtcggggctttgtgcataaaaaaagaaggtgcgcattttgacacaccttctttattttctcacaaaacgcaaaatacagcaatatagactggatgacgaggtatacgagctttccgctcaattgtaactttatccacttctgacctgcctccatatttgattaagtcttggagcaaaactactccttcccgatataaatcccaatttgatacatattaaaaaacactttatacttgaagcataaagctggatgaattcatctttatagagttcccgaacatcttcgggagcatcatcaagagtataagcagaaagattcttacgcaaagattccatatacctgcccacatcttttcctgcgtatagctagcaggatttagtttgaaaatattttctccgctaaatgcaagaaagcggttctgaagttgtttatcattcacacattctttctttataaactcgtcaaatcacctctaagcttctactacaacaagtctattttaggctgcaatattctcaaacttatataatatacatcttaatcatcgacgaacggcaaaaagttcagcttcagtttcccaagtaccatccggacgttttaccatacgttgccaacggaatgaagtcgttgtaatttctgaaaacacccactgtatattcttctcattaatttccgtctgaacaatcctgtttccttctctttttccttccagttgtgtagcccctcctaattccgtatataaaatatcccatgcctctgtattaggattatacatacgtaccgcagtcgcataagctgcatccggttgataatctttaatccgtgccttacgcgaagggcaaataaacacatcttgaattgcagtcccttccagcacccaagcgaatatccactctccctgaacatgtctttcgcctgttgtaccttggttatcaacccattcaaaatcccattcaccgacaaactgtccatacaggttatctttttccggtatcaaattgcttttcccttttgacactaatacatttataaattctcccatactttatttactgactctagattagacaaatataagatttataattaataatcactaatattaaagcaattatctgtatgcaatatctatgtcgaaagcaaacagatgcatagtataaaatactggcttccctactcccaaacagattttttatattacaccccaaaaacatttcatttacaaacttattgcaaaaaaagtatttggccattaaatctcaattattcaagaaagaagtaccgataaaaagtcttttttccctatatttgctaggctgaaaaaaatgtcattaactcaattaatatgaaaaaactatcgtttattattgtatttgtattcctgtccattctttttgtacaggcacagcaagcaaagtatgtattttatttcatcggagatggaatgggtgttaaccaagttttaggaacagagatgtatcgtggagagttggaaggcaaaattggtgtgactccgttattattcacccaatttccttatgcaaccatagccactactttctcggcaaccaacggagtgacagattcggccgctgcaggaacagcacttgctacgggaaacaaaacaaaaaatggcgcattaggtgtgaaaaaggatttggaaaccaaagttaacagtgttgcttcttgggcaaaaaataaaggttgccgtgtaggtatcagtaccagtgtcagcgtagaccatgccacaccggctgctttttacgcacaccaaggacaaagaagcagctattacaacgtgggtctggatttgattgatgccaacttcgatttctatgcaggatcagactttttagatcccaccaacaaaaaagccgccggttcaaattcagaaagtctgtacacactggtggacaaagccggatataccatagcccgtggctacaaggactatcagaaaaaagcaaaaaaatcggacaaactgattctcttacaacctgcgacagcaacagacaatagtgctatcccctatgctatcgatcgaaaaaaaggcgatatgactttaactgaaatcacccgtgccggaatcaatttcctgtctaaagatctatcaaaagggttcttcctgatggttgaaggaggtaaaatagactgggcttgccacagcaacgacgccgctaccgtattccacgaagtgatggatatggacaatgccataaaagttgcttacgaattctatgaacaacatcccgatgaaaccctgattgtagtaacagccgaccacgaaaccggaggaatcgttttaggaaaaggtccgtatactttgaacctgcaagctttaaaatcacaaaaagtaagtgaaagcggatatactaaaattgtaaacgaattaagaaaaaaatacaagaatcaagtaccttgggaagttatcaagcaatcattgaaggataatttcggattttgggatagtattcaattgaatgaaaagcaagaagcatccctgaagaaagtatatgatgaatcatttagcggtaaagagatagatttgaccaaaagtgaatatcaacaagacgaacctttggcagctgaggccaaaagaattctggatgacatcgctctggtaggttggaccagtggtgggcactctggaggttatgtacccgtattcgctatcggagccggcgcccaactattccaaggtcgcattgacaataccgaaattccggtaaaaatagcagaagctgctggttatcccaacaattaatcaaaagcaagatagtgcgacaaacgttccaagtctttctcagtgaattcctcatacaaggataactgggaaagactttttaattttccctttttcctcctatattctataattacctttgcctgataaaaattcatataaggatgagagcgaagtttgtcaagcccggccttattggcatttatccgatgaattggtgcatttccgagtttaaaccatctcaacatatcctcatctacatagttcacttccttcaactgagccatatcataaaaacctcccaaacgtttccggtaagccacaatcatgcgtgcaatgccactgcctattcccggaatctttttcaactcggtagtgtccgcttcattcaaatcgactaaagttccttccggatatttataaaccgccaacgtatctttctccgcctttttgataaagtgcaatgtatcctgtttccgccgaaaagcctctgatatctggatataaggttttaacatattaaatttctcggacgacaagccataaacacgagagaaatcatccgctgtcctgaatttaccgccggctctccggtattgcaaaatagtatgtgcaataaaaggagacaatccacgttgcaaaaattcgatggaatcggctgaatttggatcaaaagcagccaataccacctctcttcttttaggcttatcataggaatatcgcagagattccttctcctccatctcatgtactccggccagaaagttttttatttcttctatcccctcttgatcctgttccaaagactcttcctttactggaaacagaacccatatacacataaatatgaaaagcaaagtcaacaaaaaaagtatagctctgcgttcgcttttcgaaaaatagaagaagtctttccacattacaattctaaattagccctaattcattgataaaaatcaaaatgatagccacaggtgccacgtatctcaacaagaagatatacagattgaaaagacctgctttcagttttcccccattggtcaattcttcataagaaacggaacgtttcaaataccatcctacaaagatacataccagcaagccacccaaaggaagcattatttttgcagtgacaaaatcaagtaagtcaaagagtcccttatcaaacagcgtatatttctgcataactcccaatgacaaggaagaaatgactccaattataatgcacccgaaagtgaccaatctagcagcacggccacgagttaaattgaattcctcgtgcagaaaagccgtcaccacttcatgtagagaaatagtagaagtcaatgcagccaaagccaacaagacatagaacatcaccgagaaaatataagctaatatcggcacaccgctaaaagcttgctgaaaaacattaggcaatgtaataaaaattaatgatggtcccgcatccggctggatacctacagaaaaggccgccggaaaaataatcaatccggccaagacagccacaaaagtatcaatcacaccgacactcagagccgtatttcccagtttggtttctttcccaaaataagaagcataggttgaaagacatcccattcccaaactcaaggaaaagaacgcctgccccatagcccctaagaaaacatctccgttcactttactgaaatcaggcttcagcagaaactccaaacctttttccgcattgggaagcgacaatgagcaccccaccaaaactactatcagtacaaacaaaacaggcatcagcaccttcgaagatttctctatcccatctttcactccctttactataacaaaatgggtggccaataaaaagatgaccagccagataagcggacgaacagggtccttcgaaaaactctggaaagcaaccacaaaatcttccggcttcttatctgcaaaaccattcattcccgcttccaatatatattccaaagtccatcctgccactaccgaataatatcctagaataagaaaaccggccaaaacccccaaatatcccaaccacttccaatgagttccgggtgccaaaaccttataagcacgtcccgtacttgcttttgaatgacgacctactgtgaattcggcaatcataataggcattcccaacataaaaacacacgccaagtatactaagataaatgccgcacctccatgatttcccgtttcatagggaaacctccatatattaccaagtcctacagccgaacctgccgccgccagaacagccccaatcttacttccgaaatttactctttcgcttttttgcataaaaaactatcaaattattataaatcaacactggttagcctgcaaaagtataaaattaatcgtacttttgcgacgaatcacaaaaaaattaaagtatgctatattattttagaaaatatccggtatccttgatcattgtagctatcatcttttatctttcctttttcactcctcctaaaacagatgtggaagaaatcccctacatagacaaaatagtgcatatatgcatgtatggaggactctgtttcattttatggatagaatacctgaggaatcataaggctatcaattggaatcatgtaatatggggaggcatcatagctcctgtagctatgagcgggtgtatcgaactgatgcaagcttattgcacagatacccgcagcggtgactggctggattttctggcaaacagcattggagtcggactagccgccttaataggatattacttacttcgcccccttatatggcgtaaatcctaaaaagaaacgccgacgattcttcgcgaacagtcggcgtgatgataaaagtcaaagttatataataaagatagagagtcaacttaacggaaatctttcagatcattctgcaacctctgacgagtgaaaaagatacggcttttcactgttcccaacggaagtcccagtttttcggcaatttccctatatttaaatcctgatacatacatagcaaacggcacacggtaatctttaggcaacgcattcacgatacgatgtatctctttcaaatcataagcaccttctgtagaatcgaatcctgagtcctgtggaagattcaaatggaacaagttatctgtctgatcgacgaaagtctgatcacgcactgttttacgataattatttataaatatattacgcatgatggtgtacatccatcctttaaaattcgtatctggagtaaacttctcttcgttgtccaaagctttaagtgaagtttcctgcaacaaatcattagcctcttctctgtcagctgtcaatttaaatgcaaagcgaaataattcggtttgtatacttagtaaatgctgtgtaaagtcgactgtcttcatattaatctatttttaaattgttattttctgtttttgctttctgctgcaatattaacgacttctcgcaaaagtcacgacagaaaaactaacaacaaagggggtataaactatcaaataacagtttttaccccctaaattaacagttaacaggtggtttcgttttaacttttaattagccggtatccctccaccggttccagcattacctcctccacttttcaaatcatcattattaatgcttcgcgcagctttttttacctgagccttcaactccccaaaacgccaactgatattaaatccataataacgcatcggaattctggtagcagtagaagagcagaaagtaggagtattgatgttattcttaaaagtaatatatttattaaataaattggacgagttaagagatatagtcagcctcttttccttcaagaaagaacgactgagccctatcgcataataatagaaagaggaacttttaccttgcaaagagatatgcggagtaccaccccctccgttcagactcagacgcagatcccaaggcagagtctgctggaagcttccgaagacatttccttcccagccatgattctttaaatcaagccctgaacttctataatccacataagctccccgtccattgatattaaagcgggttttaggagacatattccagttcaagaacaaagacaaattaatattcttactttttcctatattatcataggtagaattcatcacaccatcttttataaaagagtattgctctataccattattgacaaaagaataattagcactgacatttacattaaatttctgcgagaaactaccgaaagtaacactaagcgaatgggccttttcactttccaaatcaggattaccgtaactgatcgcagtagggttgctggtgtcagtaaacggattcaaaaaccaaatacccggccggctgatacgcatattataagatgccctcaaactttgagtaggagccaattggtaagagaacatcaaggatggaaccaaatcatcaaactgagcatcaaacttctcatccttatttttataatccgcatccataaatgtatgctcatagcgaattcccgcctttccaccgagttttttgtacttcagctgatagcccaaataagcagccagaatatcctgcttatgatcatattgcgtactcatatcctgatcatacttatattctccggttttatcggccagataatatttaccatcacttttacttctacgaaaaatatactttataccagtttcaatgctgtgtatcgaatttatcggattggtatagtccaattgagccgtatgctcttgtgtgctggcatcatttttaaaatattggttttgcaaaagataaggaacattcaacgtatcctcataatccgtattcgcttcactgttattgggggaatggctaaaacgataagagaaagtaagaagttcccctttctttttaaacgaatgctgataatccatgttgccccccacttcgccaaagcccgattcattatttcccaaagaaccgtaaccgtaaaccggattaccggcatgattcgtcatctgggtatttccaatcctcttattcgtaaaattgccagtcatcagattcatagaaaaactaatcagattcaaagtgtcaatctcataacttccttccagactgccaaattgaaaattgccatagctcttgcttcttcgatgcgactccaaaaatttattttcctgagacgtgaaatcctcacgatatgaatcttcaaatcccttttgagatccctggtagttataagaataattaccggtaacagtgaacttgcccgactgcaccgtaccataaccgccaccatacacacgcatattgcttgcaccaccattcaatgtcaccgtatatccttccattccagctcctatagtgataatattcaagatgcccgccaccccttccgcgtcatatttagccccaggctcggtgataacctctatagatttaatggaattggccggcatactccgcaatacctcggtaggattattgctcatcatgttattcggcttgccattaacatgcactttaaacttactgctaccgtttacttgaattttatcctctccatctacagtcaccagcggaactttacggagcatttcaagagtcgtattggttttagaatccggatcatcctctatactatacgtcactttgtctatttccgcctttaccaaaggtttctgcgctaccacctccactcctttcaacatttcagtcgcttctgctatcagaatcttacccaaatcaacattcctacgatttgccgatatcgagaactccttctgtacaggagactttcctacagaagtaaaatgaatgagataagtccccggcacggcaagccgttcatcaaacctgccgtccgctcctgtcacagccagtttcaccggctttgcaggattgttcttcaatgaaatacggattgtagaatacggttccccttcattagacaaagaatctaataagactcccttgactgagaactggccttggacagccttttgcgccttcgccgtaaatgacaaacttgccacaagcaagataatgccccataaaatgttgtgtttcatatatcaataatgagtttgtgtttgttgcaaaggtaggtaaacgatagcaagtagtttattttcagacgttaaagaagcctatatattatctaccagcgagtataaggattcttcatcaaaaaagaattataataacgaatatctcccgttacctctttttcgatgaaatggggctttttaaacaattcgtcctcactattcaattccacttccgctacagtcaagccttcattctcaccataaaactcatccacttcaaagatatgctctccacttttcaccaaataccggattttatcaatcaccccaggctcacacagtttcatcaactcttcggcctcttgcaaactgatctccttctcccactcataacgacttgtaccggagtcattggaagcccctttgatagtaagataccctttattatcccgaatacgcacccggacagttcttccacgagcactacagatataaccttgcacaatatgactatgtgcataagcctctagtttataactgtcgtcctttactaaaaattttcgttctatttcttgtcccatagcgttttaatatataaaaaagccccgcagagaataacctcagcaggacttcactatttattttccgtttttatccatacatggcatagcctaccataataacaagggctaatacaattaatccgatgaacagaccttttacaatcctatttgctttctcttcttcccgcttactataagcagctttcttattctttcccataagtatttcatttttaagattaaaccatctcttttgaatattccaaaagtacaaagtttctagaagaaaacaaataaattacgaagaatttactaattctccgaaccggaaaactccatcaagtatgccttgataaagccatcaatctttccatccatcactccgttcacatccgaagtttgaaaattagtacgatgatccttcacacgacggtcatcaaagacataactgcgtatctgtgatccccattcaatcttcttcttgcctgcctccaccttggcctgttcttccatgcggtgctgcaattccttatcatataaaattgaacgcaactgtctcatcgcattttccttattcttcggctggtcacgggtttcagtattctcaatcaagatttcctcttcctcaccggtatacggatctttatattgataacgcagacgtactcctgattccaccttgttcacattctgtccgccggcccctcccgaacggaaagtatcccaagacatacgggcaggttcaattgtcacttcaatactatcatccaccaacggcgttacaaacacagaagcaaaagaagtcatccgtttcccctgagcattataaggagacacgcgcaccaagcggtggactccattctcacctttcagataaccatatgcaaaactgccctcaatattcatagtcaccgtcttgattccggcctcatccccatcctgaaggttagccacgctcactttatagccattggtctccgcccaacgcatatacatacgcatcagcatggaagcccaatcctgactttcagtaccaccggcaccgcaattaattttcaatacacaatccatttggtcggcctcctggcgaagcatattcttcagttccaatgcctccaccgcagtgacagccttttgatacgctgcatccacttcttcttcggtaaccaaatcatctttacaaaagtcaaaagccaattccagttcatctgccatcgtctttacctcacggtaaccgtcgatccatttttgcagatctttcaccttcctcatttgtgcttctgctttcttggcatcatcccaaaaaccgggcgcctgcgtacgcagttgttcttcttccacctgaaccagtttattttctatgtccagatatctttcaagtgccgcagtacgttcttttacgtctttcagttgctctattgttatcatcttgagaatttttgcatttcaaggtgcaaagatagtggaaatctattcattttcccattattcttcgtacatcttttctatttcggcagcatagttcttgttcagcacattacgttttattttcaacgtattggtcagctcaccacgttccatactgaaaggatggggcaacaaggtaaacctcttgatctgttcataatgtgcaaactgctgctgcagtgtatcaatccgctctttaaacaaatcgataatttccggtttctgcaacagttcctccatactttcatagcgaatacctttttttgcggcatactctttcaccagtttatattcaggaattatcaaagcagaaacaaatttacgttcatcggcaataatagaaatctgatcgatataacggtctaccaccaatttggcttcaatggcttgaggagcgatatacttcccgtttgaagttttaaacaagtccttgatacgctctgtaaggaacaaatgcccatcttttatataacccgcatcaccggtatggaaccatccgtcttcagtaaacgctgctttcgtagcagcttcctttttataatagccatgagtgattccctcaccacgtagcattatttcgttattctcccctattctgacctgcacatgaggcatgatacgccccaccgaaccaaccacatggtcattatcattctcacaagcaaccgttgcagtagattccgtcaatccataacccgctaccatattaattcccaccgacaaaacaaactcctgtacagccggcggaatagccgcaccggcagtagggaagaaacgcccgttttcaatgccaatagtctttttcaacaagctatagatcgttttctcataaaatttatatttcatgtgcaatacaggcggaggagtcagccctttgtacacatattccaaattatgttcacgtcccactttaatagcatccagcatcaacttctttttcaatccggttgtctcattgattttttcttgcacaccggcatacactttctcccaaaaacggggaacactgcacatagccgtaggacggatctcctttattgtcttctggatatcagcaggacgcaagttgatagacaaagtacaccccatcgaaagacaccagcaagtccatgcacgctcaaacacatgagtaaaaggaaggaaattcataatcacatcctgatcacccaattgagggaaacgttcatcatgtgccggaatggccgcctcatagcaagaatgatgcaacatcacccccttgctgtctccggttgttccactggtataaagaatattggcaagatcaccattacccgactctgaagtacgcttgtctacctcagtttgatgcggatgcgcctcgcccaatttcagaaagtcatcaaaataaatggaagtctggtcccgctcatcacgttttacctccctgtcgaaaattataatctgtttcagttggcttcccagttgcataacccggaacgccacatcatattgcaactgttcacctacaaagatataacgtatttcggcatcacctaccatataatgtacctgcgcctcggaactggtagcataaaatggtacagtaacagcccgtaccccaaaagctccaaagtccacatacagacattccggtttattttgagaaaaaactgctatattttcctgtatgcctatacctaattctatcaatgcattcgaaactgtttttacagttgcggcaaactggttccaagaaaccggaatccatgtttctgttttataatcgcggtaacgcaacgctacacgatcaccatatttccctgcctgacgttgtatcaggacagataagaaagaactactcattccaaagatttatttttaattcatcggcaaagttatcgtttaatttggaattatcctctataaacaggcattaattttcccaaccagtcaaagagttagaagaaatcagccgaaagttttagttgcatatctaacttaattacctacttttttcatcaccgtttaccacgcaaaaatagtatctttgcaacacattaaattattaaaatcaagatgattgatatagaatattacacttccgaagcaaccacattgctgaattcgttaatcggtatcccctcattgagccgggaagaagaagctgccgccgactttctgcagaactatattgaagaaacaggtatcatgaccggtcgttcgggcaacaacatttggtgtatcagtccgatgttcgacctcaacaaaccgactattttactaaattcccacatcgataccgtaaaaccggtaaacggatggcggaaacatcctttcactccgaaagccgaaaacggaaagatttacggtttgggaagtaatgacgccggcgccagtgtagtatccttatttcaggtgtaccgccatctctctacaaccgagcaggcatacaatctgatctttcttgcctcatgtgaagaagaagtttccggaaaaaacggaatagaaagcgtattgccccaactacctcccatcaccttgggcatagtgggtgaaccgacagaaatgcagcctgccattgccgaaaagggattgatggtgctggatgttaccgcatacggaaaagccggacatgccgcacgcaatgaaggagtgaatgctatttacaaagtactggaagacattcagtggttccgtgattataaattcccgaaggaatcctccctgctaggacccgtcaaaatgagcgtgacacaaataaatgccggcacgcagcataatgtcatccccgatacttgtactttcgttgtggatatccgcagtaatgaatgttactctaacgaagaactattcaaagaaataagcgcccgtctaaaaagcgaggcgaaagcccgttctttccgcttgaactcatctcatatcagtgccgagcatccctttgtgaaacgcgcggtaaaactaggacgtgtacctttcggctctcctactttgtccgatcaggcgttgatgaagttcccgtctgtcaaaatcggtccgggaaagtcctcccgttcacatacggctgatgaatatatcatggtttcggaaattgaggaagcaataaggctttatatcgagatgctggacggactggtgctgtaaacgacttacaaagacgctatttcccctatagacagaccggtaacctgtgcaattacatcaaatgcaataccggcctgtttcattttttttgcattcttgaagcattcttccttacgaccttgctcaagaccttctttaagacctttttcaataccctctttaagaccttcctcacgcccttttttcaactgggtggacatcacgctgtaccagtcgcggaaattcttcaaactttcccaatactcgcctaattccttaggattgacttagctatcccggcagcctcgaaaagttccttgttcattgccgtgccgaaaagcagcttgaagccgaaatcggcataagggttgatgtatttatcctgtatgccttctgttctcatatctatccgaggtttaataagttatgatacaggacaaaagtaatcaatatactgcaattccccgtcttaaaagaaagatttaactatctatcattcatagtattttctagataaggtttaataattcctcattattccatctttcagcatattcactgcttaagtctgccgtgatacattcgtgcttattttcccctttttgtaaaccgataactctgatgtcaggaacagttttagcatactttcttattgcgagttccaataaaattcctaagcttatcgatttcatatcaggcggataaaacggttccgcactttgagcgtcatttaaacaggaaaaaataacatctattgcctgttcccatgtaataaaaaaccgggtagcttcaggatctgtcaatataagttccttcctattttctaatgcatacttccattttaccaaaacagaccctgtagaatgcaatacatttccataacgaactatcctataagcgcaattcgatccgtttatttgctcaaaatccccaaaaagattctccataagcaatttagtagccccatacgttcctgaaacttgaacagctttatcagtgcttgttgccagaataaattttatgttctgctcctcaacagttattttaagaagattcaacgtaccaagaatattagtctgaacagctttcagaggatgttcttttgccaaaatgacatctttaaacgcagccaaatgaaatatcccatcacaaccattcaatgcctttttcaataaaagataatcttcaatggggcatggaaagatttgaacgcttttaaatttctctctcagagcaatcagttttccttcattcctggctatcgcatgaatagtatgtccttgggtaatcaaccgttctatcaatttctcagccaaataaccggtagcccccgttactgcaatggttcccatactcaagctattttttatcattcatcaacacatccctcgcaacataaggctgtggagaaaactcaatagtcaacacattcgactctcctaaagctgttaatgtatggacgcaccccggtaaagtccgtaccaaatcccccttttcccaaatctcttctattacagcctcactatcatcatatttctgaaaagtggcatgcatacgcccctgtaaaataagcatatattccacctttctaaaatgataatgattgcctctaagaacctttgggacgaattgcaagaatcctatatatttagcggcttccaccgctggaattgaagcactcaaagtagtatcctcgccaattacaaaaccagttcccgcctccagcaagctataatttttcacatcccctatggattccacttttatcaaatccctgacagttatttcatcaaacattttttttgattgctcacgcacgtcaattttacataatccggcacgatattttaataaaaacaacttatgatgaggagcaagattctccaatttcaaacactcatccatatccagcaagacaaaagattcaccttccaaaatacggatatccgctgcatcgtccatcaaataagtatgatgaatatattcccacctatcatagtctgccctatactcagaccccaaataggttatagaactaaaatgcaccttttgggatttcttgtgttcaaattcttccttcagttctctgataatgccatctagaggggtttcctcctcctcaaggtagccagaaacaagagaataatatccggagtactctatatccgggttctcatctcttttttgcaacaatactctattatctgttgtagtaataatcacagtagtcgaatccatcatctttttcatcttcattattttttaaattttcattctgttgtattttcaccacacccacgtgatgaataatattttccttattcagcatatcagtataaatagcatggtttaacaccataataagcaaccaaataagagacaatatggcaaaaaaaggttgggtgtatgatttcagccataactcccaagactttttctctcttttcaaattagaaggaatctttgtgaaaagtttcacatactcatccggaaaagccttttccgcttcacataacatattcttccagtgctcatgataactccataatctctgcattacgtaaatagaccatattgaaaatgacaatccgccaaatgcaataataaatgtcaggtattcagaagtttgacatatagagttaaacaagacggtttccaatccgaataaagaaacatttattccgaacataatattaaaacggctccagataccagctccttcatactgtaattgaccaagaaggtgagtataatgttccattaatttagtgttctgcaaggcatccctatcatttaccgcttttttattatctacatccgcataaaagtttataccgcatcgaactaatttcgtcattatatcaagaatatatttttataataaaaaaggagaggatattcttctgtaatcagattcatatcccctcctcgcttgaagtcatcaagaagaaagcatatcaaatttaagctatactttctatcttagcccgaatgtttactgtacttttcttgttacagttaccttgaatgtcttggttacaacaccccagttatgagtataagtaatgttcaagtttacatcatgagtatatactgtacctgtcggagttcccttccaagtaagagttgcagtagctgcatcataagtaaagtctttttcattctcatccaaagaaatttccaatcctgtagcttcagcaacagcattaccggcagcattttttctatacaatgtttcagctatggtttcttcagcagcaatcgtagtggcattgtattttaccaatacatttttaacagcatctttcaatgtcagttcagtccatttcttcttgtctgctgcacctaaagcattaatcaaatcgataatcttaatctgatcgtttgtagccaatgccggattattatacttcaagtctactattgcagagaattccaagataggttgttccaccttccagtcttcagttgcaaacaatacacgcttggcagaaccggctgtagcatcatagatatcaactttcaaagttccaaccttagccaaatctacacgcggagtaaagacaatctgattagtgctagtccattcaatgttcttgattccgttctgttctttcatcatttcctgaacataagcattctgcttcttataatccaattcaaactcaactgtcgcatcttcaggaacaacattgtacatcttgtcgaattcttgagattccatgatgaacttgctataagcaccggcagtttttgtccatgtaccgataatagtacgactcttatattcatccttgataggacaatcaaagttataggttacagagaagttatctacagaaaccttaaacagcttgtttacgaagctgttgtaaactgcatacggtgtgttcactccgttagtcatcttctcagtagctccccaaccaaagagtccataagaagaagctccggctagcaatgacatattcttgaattgtgcaaagttagcacccggtgtcaaaatcaagaacaaagagtccttatcggcattgtttccaccgttcttataatacaagacagcctcatttttaaccgtttcaagagcttttgccaagtctgtaacctttgcaggaatagtagtcgacaaattgttatcttgataatattgattacagtcatcagatattgattcatatttcattaacttgccaccagcatcatatacaggcttgttcaatgtaatgaatgtgcaatattccttatttttattagaaataacatcacgaccttcaatagcagcctcaaagttacggacatccaaagtaatgatccgggcctgtgagctattgtatgcaaatgtaaagttttccttagcatccaacggtttcaaagcaacggttccaaatacaggattaacagcaggacgaacagccttgatgaagactacattcttcacctcgtattctttaacaccttcttcctgtggtttaactgtagtagtcacttctatcgcagcgtattcatcaatagcagacgcctggttagtcgattttacagacaaaacattatctttaaaatcaaagataccctgacgagttttaataggttgtccattaaatgtataatcctcattctgatccaacaatctgaacactctggtatatgaaatattggttgacttcaaccatacttttgctgctccggaaatgtaagcgtcaatagaatcatttacattataaacaccttgatagtcaaagcatccataagatttaccatcataagaagcaccatctgcattgattattgcagggtattcatcttctttcatattagtagaggtaaaagcatttacaatgctctttacagatgcatgtgttctacttaccgtgaaataatcggaagctgatgtatattgaccatacatagttacatccaatgaggttgcataggtattatttccaataccttcattcggcaaaatagcaaggctcaaaataccgttttctaattttgcagaaccttccatataggtcaaagcaggagcgacactacgaacctgatacgtatcaacaaaggagaatttcgcattattcaatgagaaatcacccggatataccttgaatgaagcataagcaggaacagatgcaaacaagacatccttatctgggttaagacttccttcattttccatccaatagatatcataagctttacaaacatcttcggcatcatcaacagcctgttttctgtaaactacagtctgtaaccctttgaatgcagaaccttcctgcagcaaagtatagttctgtccgtcgatagtcacgattacagtcttgctttcagcatctacagcaatgttaggaaattcattgttctgcttcaaatcagtaactttgtcaccgatcttgatgtattccacaccatccactgtcacccaagacacgtttgaaccggcagcttcaccatcctgacctctggccggaactttgttaccttcggtatctttcacatccacccaagtagcacctttgtctgtgctgacctgccagtaattaccttccacacggaattcagggataacagtagtaccggctgctccatctgttccattcgtaccattcttgatagtaattttggaaccgtcagtgaaaaccagttcatatccaccggtaacctcattacatgactgaacgaatttacctgccttaattgccgagtcaagacttgcaatggtttccttgacttcgctcaattccttgtcgatgcggtcaatgtcatcatcatagtccttacaagacacaaatgttcctgtcgaggtcaccattaaggctccgaacaggattgcacttaaaaactttttgttcataatagaaaaactttaaatttataaatttaaaaaactaaaattggttatacatatttgattcattattaatagcttagctagtttactgcctgcaaatgatgcctccttctttcttgagtctgatatgacaaaggtgataccccgacaatacggctgaaagcagagtagaaagcacttttcgaagcaaagccacaactgcaaggcagctcagtcagcgcacaacgtcgggaacaaagaagttctttggcatattccacacgatacgtgttcacaagttctttcaaattacaaccgaagtatttgttcaccacattgctcagataggtctggtttgtttcaagcagtgcactcagtttcttcagagaaagcgaggtgtcaagaaatacctgacgtatctcaagctggtacaatatacctttatatatattacaatccaccttgcgaatgtctgtttcctttccggcaaactcctctttccattgccgctcggcagccttgaaaagcaaagtcttctgtcgctcggaagtagcggtcgtgcgtttacgtctcagaaatagatattccatctgctttatgttgttttcatttaattataccgcttcaaagaccagatatattccatatataaaaaggtcttaaaaacgacatttttgtagatctcttgataagagatctacaaaaggtattaacacacattatatcaacatattacagagctgttgaaacgaaataaagaagaatataaataaatgagagaactatttttttatataaattcctattttttttgccaaaaatgtattagttctcaaaactttgcttatttttgcacagaaaatatatatctcttatcaagagatatataaatcggttcatgtaaaagcgaagcataacaaactgaaaaacagaagatttcctcttataaagagttcatgttagctttaaaagaagaaaagttcatccttttaactttttttatttcatcaaagagaaaaccgccaaccagctttttttaaaagttctactataaaagtccgggagcatttgggattattgtggaaataacaatagatcgggccctgttgcataaaccttttctatctcctgattaaacctttttatacggatgtattctatctccatagcctttggagttatctccataagctttggagttatctcccaagactatggagtcaactccaaaggcttgcggagataaaacaggcaggaagaaaacccttagccatacggcgggaaagggttagagatatggataagatcttttaaggatgaagctgactacaaggctacgcattccttacgtagggaggaaaaatccccagacagccttcttttaaaaaaagcgaaacagcatatgggcaggaagatatacatctgactacatgtatggtatatagcaacaagtcgaaatgctaaagtgagggcatatatgcaatcccaatccttacttttgcctgccatacaaaccatacataaaattacgaacgctcgtacagggtatcacaaacaatcgcatgaaataaaatccccactaaatttctgctgaccccaaagccggacaagccctcatttcagcaggctgaaggatttatatccggatgaaggaaataaagtgaaaatggttcattataaccaattgattaacaataaattagcttaaaatgaaggatttgaagaaaaaaaaacaggttatagagccaaatcttctctataacctgcatatactcaaatcaccttgaaacattcagagagtgatatctttcattatcttttctaatgctccggcattatggttcacataatttccggcagctttccctgcttgttgcaaataagcctcatccgacaggaatttgtccatcaaccgtttaaaatcatcataaccggttacttcaaaaccgcctttctgctccaacaaatgttgcgcctcgcggaatttcttgttgttaggtccgaatatcacaggaataccatatacagccgcttccagcacattatgaattccaactccaaagccacccccaatatacgaaatctcaccatatcggtaaatggaggacagcagtccgtaacagtcgataatcaaacaatcggcctgtgtcacattttcttccgtagcctcggtatagcggatgcacggacgtttcaccttatctaaaatctccctcaaatgactgtcgctcaccacatgaggagcaataaccagcttcatctcaggatgctcattgaaatacttgataaaaatatcctcatccggtccccatgagctgcctgcaacaaaagtcaacgaatcacctttgaacttctccaccagcggaagctgcttggcttgatggcagatatccagcacgcggtcaaaacgagtatcgcccacaactgtcacatcggtcacgccaattgtcgccagcaattctttggaaacttcgttctgtacaaacaaatgagcaaaagtcctcagcacctcactatatctcttcccataccaacggaaaaaaatctgattgggacggaaaatggaagatacgctataggtgggaatacctctcctatgcaactcattcaagtaattctgccaaaattcgtacttgataaaaaataccatacagggattagccaattctacaaaccgacggacattacgcggagtgtcgaaaggcagatagcagacaaggtctgccccctggtagttctttctcacttcataccctgagggagaaaagaaagtctgcaatattttatattcgggatgctccttacggatacgttctatcaaagggcgtccctgttcgaactcccccaatgaagctgcatgaaaccaaatataacgggcatttttgtctatcttgttacgcaagatatcaaatacttcccggtgtcctttcaccattttggcgggcttggcactgaacaggccggcaaccttcaccccgaatagataaatatagatgactaggttataaatcataactaccggctattacttgagcacttccacagcccgacgaatgcgtcgcaatgtttcttctttccctaaaacggctgaaatatcaaacatatgcggacctttaccttcgcctaccaaggttaaacggaaagcattcattatattacctaagtgataacctttatcttctatccatttcatgaccacagcctcctgattctccagcgagaagtcgtccaaggcctccaatacgtccgccaactccagcatacgttcgggagagtcctctttccaacgttttttacgggtcttctcatcatattccgtaggagcgacgaagaagaatttgcaagtttcccacaaatccttgataaaacttacacgatctttcatcaagcctaccacggtcaccactttatccataggagcttcaatgccatgctctttcaagatcggcatgaaaagcccggctacttcctcattgcttttcttcaatatatattcatggttaaaccattttcctttttcaaagtcgaattttgccccggctttgctgcaacggtgcaggtcaaaaagcttcaccagttcatccaaggacatcagttcctggtcatttcccggattccatcccaacagggcaaggaaattgataacagcttcgggcaggtaacccgactcacgataaccggaagacacctcaccggtcttggggtcgtgccattccaacgggaaaacagggaagccaagacggtcaccatcacgcttgctcagtttaccgttaccatccggtttcaacaacaagggaagatgtgcgaactcgggcatggtatccgcccagccgaaagcccggtacagcaggacatgcaacggagcggaaggcaaccattcctcaccacggattacatgggaaacttccatcaaatggtcgtccacaatgtttgccaaatgataagtaggcagttcatccgccgatttatataaaactttatcatccaaaatggaagaattgatcactacctcgccacggataatatcatgtacgtgtacatcttcattcggttcaatcttgaaacgtaccacatattgcttcccatcggcaatcagtgcatccacttcttctttcggcagagtcaaagagttacgcatagacatacgggtagaagcatcgtactggaaattagagatttcctgacgtttggcgtccaactccgccggagtatcgaaagcaatatacgccttaccgctgtcaagcaacacctgtacatatttcttataaatatcacgacgttcagactgacggtaggggccgtagttaccaccaaagctgactccttcgtcgaagtttatccccaaccacttaaacgactcaatgatatattcttccgcacccggaacaaagcgatttgagtcggtatcttctatacggaaaattaaatctccaccatgctggcgagcaaacagatagttatacaaggctgtgcgcacaccgccgatatgcaacgctcccgtcgggctcggagcaaaacgaactcttacttttctttctgacattgttgttttatataaaatacgccgcaaaattaatctaaatttcccgattttttcgtattttgcgcgcaaaaatatacgattatgagaagtttcaagaccaaccaacggttttcatataaaaatttgatttataaaagccttattttcattgccacagtatcagtgatagtctactttttacccaatgaaggaaagttcaactatcaatttgatataaacaagccttggaaatacggactgttacaggcatcatttgattttccgatttacaaaaacgacatacaagtacaaaaggaacaggacagcatcctggcagactatcaaccttatttccagatagacaaggaagccgaaaaaaatgtcctttccaaattaagggaggattacaacaagaccttacgccattcactgccgggcacagactatgtacgttatattgaacgcacattaaaggcactgtatgaggacggaatcattgccggaaatgacttgaagcgtatggaggaagacagtatcattgccatacggctggtagacaagaatgtagctacgagccgttttatcgaccaattgtacaccgtgaaggaagcctatgaatatttgctgaatgcggataccacccactacaaaaagaagatattacaacaatgtaatctgaatgattacattacacctaatctggtttatgatgaagaaaagtccgaggcggcgcaaaaagacctgctctctaatatttcatgggcaaacggctttgtgctgaacggacaaaagattattgaccgtggagaaattgttgatgagcagacttacaacatattggaatccttacgcaaggaatgggaaaaacgtagcgactcggtacaagagaaaagactgacattggccggacaaatattatatgtaggaatcttcctgttctgcttcatggcctatctggagttgttccgggcagattattatgaacggaaaggaacactcaccctgctatttgcgctgattgtgttcttccccgtcctgtcttccattatggtggaacagaacttgtcaagtatttacgtggttccatttgccatgattccgattatagtccgtgttttccttgactcaagaacggcattcatggcacatgtcactatcattttgctttgctccatcactttacgttttccacatgagtttatcttgttacaggtagtggcaggaatggtggcgatctatagtttgagagaattgtcccaacggtcgcaattgttacggacggctttggttgtatttatcagttacgctttattatattttgctttcgagctgattcatgaagatgatttgaccaagctgaatacgcgcatgtacatctattttatgatcaacggtatcttactgctgttcgcttatccgttactgttccttttggagaaaatattcggttttacttcagatgtgactttggtggaactgtcaaatatcaacaatagcttgcttcgggaaatgtccgaagtagctccgggcactttccaacactcattgcagatggcaaacctggctgctgcggcggcaaacaagattggaggtaaaagccagctggtgcgtacgggagcattatatcatgacatcggtaaaatggtgaatccggcttttttcacagaaaaccagtcgggagtcaacccgcacaagagtttaagttatgaacaaagcgcccaggttatcatcagtcatatcaccgacggactgaaactggcggaaaagcataatctgcccaaagtgatcaaagactttatcagtacccatcatggacggggactgacgaagtatttctacatttcatataaaaacgaacatcctgacgaagaagtggatcaggaaaagttccgctaccccggtccgaacccgttcaccaaggaacaggccgtcctgatgatggccgactctgtagaagcggcttcacgcagcctgccggagtacacggaagaaagcatcagcacactggtagataagattattgacacacaggtatctgaggggtatttcaaagaatgccctattacgttcaaggatatagcaacagtcaaagcactgtttaaagaaaagctgaaaacgatgtatcacacccgaatcagttacccggaactaaggaagtaagcaatcctgcacaagcatcttccagtatatcaagcacgttctcgaacccttgcgcaccgccatagtaagggtcgggaacatagtctgccactttggtgcggcaataatccgtcatgcgatggattttcttttccgtttccagatcgggagcacgctccatcaggtcctctatattacggtcgtccatgccgatgatcatatcaaaatgatagaaatcctccgtacagacaggacgggaacgatgggtcagattgtaaccgcggcgggaagcatgcatccgcatacggctgtcgggcaattcccctctatgataactcaggattccggcagaatccacctctatctcgtgttccagtccttttttctttatgagagtacgcatcacttcttctgccgaagaagacctgcaaatgttaccgaggcagacaaaaagtattcttttcatatataatctacaaatgaaggtattctttaaatgatttcacatcacggttcatgatcagctcttcaggaaacccggtaagctgcaacaattcatacaaattatcgtaacgggctatatcaaacgaaatatgcgcgtcacttcccaaaatgaccggaacttcatatttcttgcataaacggagaatggtgaggttgttctcacgggcattgggtttgttacgggtgggttttaaagaactgttatttatttccaataaagtatggtgttctttggctgccaataccatcggttcaaaatgtaacgccgccgtaccgtctccggggtgactgataatatgaataaaaggattgctgataacctgtaccattccatgggtgttttcttctatcgttccatattcataacataaagagtggatacccgcaatacggatatcaagcatcttcatataatcctcgtccaaatcgaggtttcctttaccatccagaatattaatctcagcccccaacaacagctccaccccatacatccggcggggaaccacatgcaagtttctaaaataaataggatggcaagtaccgggaacaccgggcgaatgttccgttatccctaaaaccttcaatcccttatcggcggcagcttgcgccatttcttgtaaagtactgaatgcatgcccgctggcaatggtatgggtatgtacgtctaattctatcttcatctttattttcgtttatcttttctattatcgtccagtgcatggaccggttactgtggatctacatcataataaactaacaacgaacggaaacgttcatcttccaatatggcacgttgtacggcaagcagataatcacgcactttctttatagaagcattctgctccactttcacaatcattttttttataaataaggtctggatacgggccaccggcggtttgtccgggcccaataccctgtcgcccaatccggaacggagctgtgccgccatggtatccgccgccaaatccagaatatcctctttgcggtgtttcagatatacataaatcaaacgataataaggaggatatttgaacatctgccgttctgccaattggtcataatataactgctcatagtcattatgcatcacttgatgaataacgggtaaatcgggcgatttggtctgaaggataaccagtccttgcttatttttacgcccggcacgtcctgctacttgggccatcagttggaaagcacgctcatagctccggaaatccgggaagttcaacatcgtatccgcattcagaatccccaccacactgacatgatcaaagtccaatcctttggacaccatctgcgtaccaatcaggatatcggtcttgccctgttcaaaatccgcgataattttctcgtatgcggtacgggtacgggtggtatccaaatccatccgggcgactttcgcctcgggaaatatcagttttatatcatcttctatacgctctgtaccgaaaccgcgatgcatcaattccactccgccgcacgccgggcaggaacggggaacttgataggtatatccacagtaatggcaagtcagctggttcagccccttatgatacgtcagactcacatcacagttcttgcatttaggaacccagccgcaggtatgacattctatcatcggagcgaaaccgcgacggttctgaaacaggataacctgctccttacactccaatgcctcttttatctgcttgaccagcgccggtgagaaagggccctgcatccgcttctgatgcgccagttccttgatgtcaaccagttctatatgaggaagccggatatctttatatctttctttcaattctaccaagccatactttcccgaggtagcattaaagtaagtttccacaccaggagtagccgtccccagcagcactttcgccttgaacatagaggccagcatgatggctgagctacgggcatggtaacgtggggcagggtcttgctgtttatacgtattctcgtgttcctcatctatgatgaccagccccaagttacgaaaaggcagaaaaatagaggaacgaactccgagaatcacatcatagctcttctctcccaactgtttctgccatatctccacccgctcagcgtccggaaacttggaatgataaatacccagccgatgtccgaacactcttttcaaacgctcagttatctgagtggtcagtgcaatttccggaagcaaatataagacctgctttcctgttttcagcacctcctgaatgaggtggatataaatttccgtcttgccactggatgtaacgccatgcagaagacacacatttttctctctgaagcattgaagaatgttgccataagcctgttgctgcgcaatattcagcggattaatatcaccggtatccgaaattcctttatccaaacgtcctatctcctgatgatagacctcaaagactttcttttcgaccaatccgttaaaaacggccgcagaccctccagacttttcaagcagctctttctttgttacttcctttaaagcataccctctggctacccaaccggacaattccacatacttcattaatatcatcaattgtttaggagcacgtgacaattcattgaacagccgttgtaagtaagcctcatccgcttctccgttcaccaacctcacccttgcctctgtacgcggtttgtaattacgtttcagttcctccttgacaaagatggcctctttgtccaacaaagacttgatgacagtcaacacatttttcagtccgctgttttttttcaactgggttacacactgttctgtatcccggctcaacaaatccagaattttctgctctttctccggtaagggtgcagtggcttcaaaatcgggattatattccaccaacgtttcgctttccagtttcatacccgaagggatagccgccttgtacacatctcctaatgtacaaagataatattccgccagccattgccagaactcatattgtttcggtaacagtaccggagatgaatccagcacttcagctatatccttcgtttcatacccctccggggccgcataatgtacatttgtcactattgccgtatagaactttttctttccaaacggaacaaccacccgacaaccaatctgtaccatctcttccatctcctgaggaagggaataagtgtattggttggcaataggtaatggaactatgacatctacgaattttttcatggtgcaaaattacaaaaaaggaggcattcagtgaagaatgcctcctttttatcttttattaaataaggttgtctagaacaagtatgccaaagaaacttgccaagtgttgttctttatattaacagaatggtgtccatcacccgatccaccctctgtataatattcataagtaccagtcttgctcagagcaaaattataattaacccctaactgtaaatgacgtatcaatttaagacctgctcctacattgaaactggttgtagattttttcaatgacaattcacgcgtccatgttttattgccaatattaaaatcaaactggggacctgcagcaatataagcacccaacatgctaccaaggccaaaggaccatttcaaattcacaggaactgcaaatgtctttaacttcattgttttctctccatcgacccctaagtctgtctgagaatataaagcggcaacatctgcccctatcccgataataggcagggtgaattcagccatcggacccacaaaaaaaccagtcttattatcccctttaaaagcatcctttgaaaaactcaattttgaaatattcaaaccaccttttactccaaagtgcaactgagcctgagcaggagcagccatcatcaaacatacagctaccattaatacactaataatctttttcatgtttgtctatttttagtttacgccacaaagataaacactttttccatgtataatgttcaatctcccaggaaagttacattacgctttccaatccccccttccaagaagaaatatcaaacaaaaaacggacagaattttttattctgtccgccatgttctctttctaatattcttcctcattaaaaaagaaatcctctttgctcggataatccggccaaatatcttctatactttcatagatttcgccttcatcttccatctcttgcaagttttcgattacttccaacggagcgcccgaacgcattgcatagtcaatcaactcatcctttgtagcaggccagggagcatcctctaacttcgaggccaattctaatgtccagtacatagttttcttattttttaagtaaatacttttctttcgttctctaattagccgcaaaagtataataaattatttcatttgcaacttttatcccaaaaaatttcatccgttttagttaaatgatttaactttcgggtcaaaatgaataaataatcagataaacggttgacaaatgctgttacacgggcatctatgtcacattcttcagccaatgcaagaatgcgtcgctcggcacggcgacacaccgtccggcaaatgtgtccaacggctgctccacggtcaccccccggcagaataaaagcattcaaaggaggaagttcattgtcaattacgtcaattgcctgctccaacatccggatgtcttcatcctctatacgactttccatacgcaacttggtctgtgtctgatccgttgccagatacgaaccgacagagaataatttattttgtatacgaaaaatgatttgtttatcctcctcatccgtcaaatacgtttgcaacaatcccaaataggagttcaattcatccactgtgccataggcttcaagccgtatatgcgttttcggcacccgggtaccacctaccaatgatgtggttcccttatcacctgttttggtgtatatcatgcttttcttcatggttccggttataaaaaatttacaatataatgctgtttatatctcgctttatcaaaaaagaccaaccctatgtcatacaaatcaaaagtgatacccgtcgactcactggctacaatttgctcccaccatttccgtttttccttcgattcatgaattcctccgacaataaagcaactacgaggtccggcataaggaagtaccagttcaaaaacttctttataaaaaggagtatgccctatatgcagacaatctaatgtatgcacctccgccagtttctcctccagttgccgggaagtctttgcccaatccctgcctttcaaggtgacggagtccatagtatgacacgcagcccgcatatatcctatggatgccccattaccaatccccacttcaatcaacgactttggtctgaaataattaaccaaccggaatagcaaacggttcactttccttcgataatgtggcaaataagcaggaaatcccctttccttcaatacccgataagcatagtagtgatatttttcataaacaacagaagtaatcagaaaaaaatcagacggagagtgtactccgtaaccacaacggtgacggaagcgactgcaccaattccatatacgatgaagaaaaaacatatttctcagctttattaagtaacacaaagataaaagattacccgacaatatcgaaataaaatactatttttgttgcccattagttattaaaccatttataaacgatgaaacacacactctcttttatggtatgggcaatactggctgtcttattgcctttacaaatggcccaggccgcagctcctcccactgaattacagaaaagacttcaaaatcttccggacatcagtgacattaaaccaatgcaaagtgatgcctatccggagaaatatgtattcttcattaatcaactattggatccgcatcaccccgaagcagggaatttcaagcaaagggttattctctcgcatgtaggttttgaccgccctaccgtactggttaccgaaggctatgccgcccattatgccacccatccgcgttatcaagaagagttatccaaattattcaacgccaatctggtattcgtggaataccgttattttggtgagtccatgccgaagccctgcaactgggattatctcacggttgaaaattcactgtatgatttgcatcatgtaaccacgaccttgaaacaactatacgatgagaaatggatagctaccggaatcagcaaaggcggacagactacgatgttctaccgcacttactttcccgatgatgtggatatctccgtaccttacgtagcccccctcaaccaatcattggaggacggtcgtcacgaaccgttcattgccaataaagtttcgactcccgaaaaccgtaaacgagttgaaaactttcaactggaagtacttaaacgcaagagccggctgctaccgatgttcgaaaaatattgctcggataaaggatataccttccgcattcctatagccgaagtatacgacttcaatgtattggaatactcatttgccctatggcaatggggaactcctgtaaataagattccggaaacaaatgccgatgaccacacgctattcaagcatttcatagctatttgtgaaccggattatttctccgaacaatctccctacccttcctttaatgtgcaagcggccaaagaactggggtattacggatatgacatcaaacctttcaaaaagtatctgacgataaagagcagccgtgactatcttcataaggtaatgttaccgcccgaactgtcaaatctcaaatttgacaagacactatataataaggtggtaaaattcctgaaagagaatgatcccgaaatgatctatatttatggcggcgatgatccttggacagcttcgggtgtcacttggctgaagaacaagaaaaacataaaagtttatgtattacccggcggcagccataccacccgtatcggcagctttgacaccgacacacaagaagaaatcaagacacaaatcaatgcatggctgaataaagaatagcaaagagacgagataaaaagcttttccgccacaggttacgcagattgtcaccggttatttccattgaggacccactgtttaaattggaccgatgtcaatctgagcaatctgtgacggaatcttgattttatcataaaggcatattgccatgtttcttaggcggattgctttggtttttattgtgacacatttccaaagcttgaataagtttgtaacgagtgtcacggggcataatcacctcatcaatcagaccacgttctgccgcacgataaggattggagaatttatcttcgtattccttgatgatctcagctttctcttccggagcagacttgcggtaaaggatattcactgccccttctgcacccatgacggctatttccgcctgtgggtaagccaggttcacatcggctcccgtcggcttgctggacatgacaatgtaggcacctccataagctttacgggtaattaaagtaaccttgggcactgtagcttcagcgtatgcatagactatcttcgcaccgtggcggatgatgccgttgtgttcctgtaccgttccgggcaggaagccgggaacatcctcgaaagtgatcagaggaatattaaagcagtcacagaaacggataaaacgggcagccttgtcgctggcgtcaatgtcaaggacaccggccagccaggcgggctgattggcaacaatacctacggaacgacctcccaggcgaccaaaccccaccaccacatttttagcaaagtgaggcatcacttcgaagaaatactggttatccagcaccggttcgatgatatcctttatatcataaggcatgttcggatcttcgggaatgacagtctgcaacgcctccacctgacgatggatgtcatcgttgcagggaaccagcggcgcatcctccatattgttggaaggcaggaaactcagcaattcgcggatactcatcagcgtttcctcctcattatcgcacataaaatgggtcacaccgcttttgccgctgtgagtctgggcaccacccagttcctccttgcccacctcctcgttagtcacggtcttcaccacatccggacccgtgataaacatgtggctctgctccttcaccataaagataaagtcggtcagtgccggggaatagcaggcgcctccggcacaaggtcccagaatagcggaaatctggggaataacacctgatgcaatggtattctgataaaagatggaggcatatccggccaagctgttcaccccttcctgtatgcgtgcaccccccgaatcgttcaaagcgataacgggagctcccgtcttcaaagccagttgctgaacctttacaatcttggccgcattggtctcgctcagcgaaccgccgtgcgcggtgaaatcgtatgcatagacaaacaccggacggccgtctatctttccgtaaccggtgaccataccatctccggcaatctgcttcttctccatgccgaagttggtacaacggtgattcaccagcttgtccagttcattgaacgtacctttgtccagcaacattccgatacgctcgcgagcggtcatcttcccttgggcgtgttgtttctcgatcttgtccacaccgccgcccagcgacgcgcgtttgtccagctcttcaaaccggctgtatatttcttctcttgtcatgatcaatcttcttttattatatccaatactattaatacctggttagcattgacggaatccccctcattgaccaggatatcccttaccgtacagtccgaggtcactttgtagttgctctgcatcttcatggcctccagcactaccacaatatccccggatgacagacggtcacctttccggacgggaattttcacaacctttccgggcatgggagccacaatcttgtcatcctgtctctcctcgccgccctttttcatacgcagatacttggtctgggtgtccactatgtccacatgataggaacggtagaacatattcacatcataactttttccaccctccccacggatcagttcggcattgaaggaattgccatcgtgcaggatggaacagcttccgttctcggccataacgatatccacatcatacggttttccgtcaatcataaactgtaccttgtttccttccttgctcaccaacgtcacatcggctacgcggtctccaatatgtatttccatacttttgcttaattaaatgaagaatcagattctcaacactcctttctgcaagccgaactcacgccaacggctgatgggacgggcatcagacagctggggactcttgttctcttccagattcatcagatagtcaatataagaggcgatcatggccatgttttcaatctcctcattgttgccgttaccacggagcagcatacgggagttcttctctataaataaggtattatactcacccttcacaaagtcgggggtatgcatgatgcgtttcagataactgaggttggtcttcaagcccgtaatcttgtactcgtaaagcacacggcgcatacgctctatggcatactggcgggttgtggcccacacgatcaacttgcctatcatcgggtcgtaaaagacaggaatctcgtacccttcgtacacgtagctgtcaatgcgtacgccgatgccgttaggctccgtcagctgtttgatgatacccggcgaaggcatgaagttattctccgtgtcttccgcacagatacgacattcgatggcatgaccgcgctgatacagctcttcctgtttcaaatgcagcacttcatcattggcaatgcggatctgctctttcaccaagtccacgcccaccacttcttcggtaatgggatgctccacctggagacgggtgttcatctccagaaaatagaaattgcggttcttgtccaccagaaactcgatagttccggctcccgaatagttcactgccctggcagcagctaccgccttttcccccatctcctgacggagttccggagtaaggaacggagacggactctcctctacaatcttttggttgcgacgctgaacagaacactcgcggtcaaacagatggattacattgccatgattgtcacccagtatttgaaattctatatgatggggttcctccacaaatttttccaaataaaccgtatcatccccgaaagaagacatggactcggaacgggcggtgttatatgcctccaccacttcatcttcactgtgtatcagcctcatccctttaccgccgcctcccatagaagccttcaacatgacaggatagcctatttcattacagatacgtaccgcctcttcggcactttgcaacggctgttccgtaccggggactacgggaacacctgcggcaatcatacgcttacgggcggcaatcttgtcacccatcgcttccatcgtctcggcggcaggaccgataaagatgatcccctcctctttgcaccggcgggcaaaatcagcattctcggacaaaaaaccataaccaggatgaatggcatcggcatgatgttgccttgcagctttaatgatattatctatattcagataactttctttggaagcggcaggccctatcagacaggcttcgtctgcatacatcacatgacgcgccgtacggtcggcttccgagaaaacagccacagtgcggatacccatctctttgcaagagcgcataacgcgcacggctatctcgccacggttggcaattagaaccttttgtatcataatctttctctttttacccgaaatgtcacacaaaattacagatgcattcattatacatgaacacatcttacatgggtggcatctctcattagtattgattatttaacgaaaactccctgttttttagaagtgggagccataattggctgcaaagatacttgttttttgcacaaaaactacaaatgtgtgtctaaataatgtttcaatacattggcatgatttcgctcctgttctttcgaagcgtaaagtaatgttactttcgaataagcttttatcttatcaatgaacgctttagcggcatccgattcattcaattctttttgatacatatctgcaaaagtcccccatcttttttctatatccgcatgaaaccatttccttaaatcattggatggagtgacctcttttgcccaataatcgtatttcaaatattcccgcttcatgccacggggccacaggcggtctaccaaaacacgatagccgtcttgttcagaaggttcatcataaaccctcttgatgtttacttgagtcatagttggttattttaatttaggtacaagcttataactccatataaccctaaaaagttcattccggacagtggtttcaggataacagcaactcgtaatccactacatccaaccatcgtccgaatttcagtcctaccttcttaaaatgggaaacttttttaaatcccagcctcaaatgcaaagcatcactgacaacatttccctctgtgacacaggctatcagtgcacgatacccgtccctacgacattcttcaatcaatctttccatcaactccctgcctatgcccttcccctcgtatccgggagctaaatagaccgttgtttccaacgtatgcctgtaagcagccctctccttccacaaatgggcataacaataacccactactttcccttcttcctcatacacaaaatagggaaaacggacggcaattccggcaatacggttacgcatatcctcctctctcaaaggttccgtttcaaatgtagccacactgtgcctgacatattcattgtatatcgttgtgatggctttggcatcctgaagttccactcgtctaatcataatgtcatatctattattaaaacgtaagcaagatataaaaaaataatcagttatctagagaataatcactatatttacagccgattctaatttcagctataaaaatgacagaaatagtagaagtaaaagactttatcccagcctacaccgatgcagtacaaaaactgctggagcagctcacaaaccgcccggtaaaactgaccgggacaaccctcagagagatcatatcccaagaaaacacccatctgtttttcttactggctgatcaggaaattgcgggaatgctgactgtaggcatctatcacagccccacaggcggcaaagcgtggattgaagatgtggtagtggatgaaaaataccggggacaaggactcagcaaacagctggtcacccacgctgtccggtttgtgaaggaacaaggcatacctcttattatgcttacctcaaaccccacacggatagcagccaacaagctatatcaaaaattaggcttcgaacaaaagcagaccaatgtgtacagaatgaatttagaataacccattcctatttcaatatgataacaatcagacattcattgcccaaagatttggatgcaattatagaaatattccactatgcccgtcagttcatgaaagagcatggcaaccccaaccaatggataaacggttatccttccgctgaattgattctgcgagaaataaccaacggaaccaactatgtttgcgaaaatgaaaacggagaaataataggcacattctgttttattcccggagaggaccccacttatgcccgcattgatgacggcaactggctgaacaacgaaccatattacgtcattcaccgcatggctaccaacggcaaacagaagggagtagctgacgcctgcctcaaatggtgtttcgaacattgcaacaatatccgggtagatacccaccacgacaaccttgtgatgcagaatatcctgaaaaagtacggtttccggcgttgtggcatcatttatacccacaatggcacatcccgcatcgcttaccagcggacattaaccgaaaaagagttatctttgccgaccgaataaacaagaaaaagaaacatgaagattctctggatagacctgaacagttcatatgcccattcctcattggcactgccagccctacatgcacaaatcatgacagacccttctatagaatgggaaatcgtatctgccaccatcaacgaaaatacaggaatgattgtcgatgagatctaccgccaccgacccgacatccttgccgcaaccacctggcttttcaaccatgagcaactgatgcatgtcgcttccagagtaaaagcattgctccccgaagcctgcctggtgctgggcggtccggaatttctgggagacaatgaagagttcctccgcaaaaatccatttgtggattgtgttttcagaggagaaggagaagaagtctttccacaatggttgacctgctggaaccatccggaacaatggcacaccgtgcccggactctgttacctcactcctaacaaagaatataaagacaacggtatagcccgcgtactgaatttcgccggactcgtcccgccagaacaaagccgtttctttaactggagcaagccctttgtccaactggaaacaacacgcggatgtttcaacacctgcgccttctgtgtcagcggcggtgaaaaaccggtacgcaccctttccatcgaaagcatccgcgaaaggctacaactcatccatgcacatggcatcaaaaatgtacgcgtattagaccgtacttttaattacaaccctcgaagagccaaagaactactccggctctttctggaattccatcccgatatccgcttccatctggaaatacatcccgccctgttgtcagaagagctgaaagaagaactcagcctgctgcccaaaggactgcttcatctggaagccggcatccagagcctgcgcgaacctgtacttgagaaaagccgccggatgggcaaactatctgatgcactggatggtctgagattcctatgcgccttgcccaacatggaaacccacgccgaccttattgccggactgcctctttatcaccttcatgagatatttgaagatgtccgtacccttgccggatatgctgcgggagaaatccaactggagtcactcaagctgcttcccggaaccgaaatgcgccggagggcggaagaattaggaatcaaatattcccctctgccgccatacgaagtgctacaaacccacgagatcagtgtcagtgaattgcagacagcccgccagctttcacgcttgttggacggattctacaacacaccggcatggcaggcactgacacgtgaactcattttgaatgacgaacaattcctccatcgttttcttgcatatttaacaaaagccaatctgatagaccagcccatgagtctggagaaacgaggcttgatactgtatgagttctgcaaacaaaactaccccgaataccagatacaggctgctattgcctggatagaagcaggcatgtcactgaaaaaactccctgccgagaaagtatggaccaaacgacaaatccctcctgccacttggaatatcatttatggagaatacaaagaaagccttcgtctgtgtttccttcctgccgatgaaaagggggaacatggctactggttcggctttgagtcggagatacaaaaagcaagtcctgtattcaaggcaagaacgtaaaacgttacgacatcaggagaagctgttggtttcaaaaagtaatgctcgattttgatttagtatcactttatagaagtgaagccaagcggctgaaagagcccaacaagagtaatccggataagagccaaaggaaaaggtgatttcgtcttatgtaaaacataaaattcttctgtcacaccatctctctcattaccagcaatttaccgtataaaaacatccataatgtccctgaaccggtatgtaggcaatggagatggaaacattcgcccattatttgtataagagccgcagatatcagattggatctgacaggacatgccgtgctttcatttaatttaataggatgtcattgcgttaacttccgatatatactgttgcctcacctatgtgaagcagtgattccactttagtgacaacggatattcacacagatgaaaagcccttttcacccaagtgaaatatcgggtacaagccatagaaatcataggaaaacaaaagaatttattttccttattatcaactatttgcatatttcctatattctccatttttccctattttgcccgtttcctattattcagtacgcttttagtacactttgaaatctcattttcttttgtacctttgtaatatcaggaaataaaagaaaatcaactatttagtataattacctggctacagtacctaaatcgggataaaacctctaaacaatgggaaaagttaagacgaagtttacgacagtcagaggaggagccaagaaaaaatagagggctcagaatataaactaaaaagtacagaccatttttattatggtctgtactttttataactttgcaatactaaatcagaacatcaattatgcaacaaaatattataagcaatttctttcgccctataaatacggacatacagataccagatagcgagtatgcaaaaaccgatgtatgtattgtcatggctgatgctttggcccgcaataccaatcatagcctatatatcatagactatcaccgcaagaatttcctttacgtatcgtccaacccgctttttctctgcggtcattcaccggaagaagtgcaacaaaaaggttatgccttctactttgaggttgttccgtctgacgagataaaccgtcttatggaaatcaacgaagctggattccggttctactatgaccagcctatagaaaaaaggcttgacttgtctatcgaatataactttcatatccacacatcagaaaagcatccgcaccttatccaccacaaactaacacccgttttgctaagtggcaagggagatatatggctggctctatgtacagtttcactttcaccggagaaaaacatcggagatgtagtcatatcagaccatacatgtactgaccactatatctattcattcgagggcagacgatggagaaaacagccggaactaattctttccgaccgtgaaaaagagattctccagctctccgtcaaaggactgtcgaacactgagattggagaaactctctttattgatgccaataccgtcaagtttcacaagaagaaaatcttcgagaagctacacgcagaaaacatcactgaggccgtgggtatcgcagccaatctgaggttgatttaggaacacaatgtagaactttggcaaagtagctataggaggatgtgagaatatgtattcctccattttcttccgtccaagttcgatgaccttttcatcgttacatctgttcatcttttctttatcaataaaggcaatatgccagaagaccagataaccgattacatacctttcgatggtaacttctatcggttcgtccggacgcttcatggattgaaggccgttgcggacgtccttgtcgatgatgcccacaactgcccatgagagatttatataggaaattgatgctgtcataatttacatacggtttattgtatcctgtcctgctcccgtacctttatacttgcttttggctgcattaaacttgtagcgcactgtaagactgaacgagcgtgtatcactccaagacaaatccttcatttgtgcactctccatataaagaagtgcttcctgcttacaacctaacaacaagtcatttgcacgcgcttctatacttagggcatcattaaaaagggatttgcgtaagcctatgttcaaagtatattgtggacgtttaagggtgatattctgaacctgaccacgactttgataattaaaatcagcagagagaaggaatcctgcaggaagagtaaaagtattgtttaaggaacctacaaaaagtggattgttataggtccttctctgaccggcggcatccaacgagaaccactgcttcatcacaattgcgctggcattaagattccatataccaatagtaggcgaagctgccagcattactgtcagactcggtaaacggtcgtgattgatatagtttattaaagtagtagccgactgattttccacctgtgttccccaataaaggatatagtcccgaagcactttgtagcttaccattgcctgaaagaaccgccatacaccaacagcggttatatcatgcgtaacacttggttttaggagtggatttcccgtttgccatgtaaacctattggcataagtgatattatttcttaactgactgtagttgggacgctgtgtttttgcagcatagctgacttggaattgtactttccccaattgcccgttcacagaaatatttggaaagatattatcatatacacggctttgtccgggtacaaatgtagcattttcaaaataatcaaaatccacatgctcatatcgcaagccaatgtttgcctgaccgaatggtaaaggatggctgtactgtgcatagccggcaagattctgttcacggatgcgggtataggttgtaggtacatatccttcctgatttacataatcatcatgccggttggtataggtatattctcctcccacagagatacttcctccccataagggatgagtgtatgaaactttggtggcagtaagttgattttccaccctgttatcagaagtgacagtacggtcttcatggtcctgactattctccatattaatggtatattgcgtgtatgtattgctgtaatagtctgcatcccaggtaagttctcctttgcctatttgtcctgcatagtaaatattaagctgatgttccggttgtgattttgcatcggcagcaatggtactatataaaatatcgtaaggcaatccatctgcctgaatctcgctatcgaaggcggtaaacatatctgtatgcagggcattgctcaaatcataacgtacacctatggaatgatactcattaaaatcataattgaatccgatgcgtccgtctatactgcgagaatcggtattagagtgctgataattcttttgcgtccatatggtatcggtaaaggccgtttgctccagaatatcgttttgcaaggaggtagttttatcaaaacggaccatagcgaaaacatcaagaccgttatgccgatagtttacatcggcttgctctacaaagtctgaattttgagattgatcataggaacttcgcaaactcactccaaatccatctccttgtcgtttgacagtacggatacgaacaactgcccctaccgttgcatcataacgggcaccgggattacgaacaacttctacgcttttaatttcctccgatgtcagttggtccagttcagcgatatcacgtaattttctaccgttgatatagataagcggtgaacctttacccaacacctcaaatccatcagcctttttttgtaaaccgggtatatgcgccaatacatcttcagctgttccggctttcgagagaactgtaccctgcacattggtttccagagcatcattctttatgcgtgtcacaggcaaattggcttttactaccacttctccaagcatccgtgcatccgatacgagctgcacgatacccatattggcaggagtagtcggtttatacactgtcttatatccgatagaggatattttcactatctggtttaccgatgtagcttccagcttaaacaaaccatcttcaccactgatggttccacttacaaatgccgaatccggcagagacagcagcaccacattggcatatggcaacggatggttactttcatctacaagtttccccttcacggtttgtgccgacactctcatcggcagcaacatgctcacgacaagcatgaccaaatacattttcatctttttcattgatatatcctattggcacactttgaatttgcttttctttccatttatccggagcgtcacttggggatttgagaattgcgtgacatgaggaaatgtgagtgtgacagtggccacccccttttttactgttacttctacggatgttgccggatattctttttcactccatgatgacggaatgagttttacatcagaaaccgtgtatttgtctttggcttgattgtccgtgaaaacgatggttactttgttgtcgtaattgttgaaaccttgacaacgtggctttgcattaactgtcaaacctatgacagtcaagaaaattactgttacaatataaaatacatttttcattgtacgatgtttttttgatttctgcagcaaagttccacacttccgaagacttctccactaccctgtagagtagttttgattacaggagctaaaaaaagaggagatataatacatataaagaagggagtgaataggtttacccatagtaaagactaaacctgtagttgatttttggaacgtaaaaaaaggtataaacccaatgcttgatttacacccttgcaggcggaaggacaggtatgccgtcgttccttttacctcaaaagacgaatatcagatttcccataccgacccgattcccgttttattcatttaccgtttctatcgtatcgctgcgcctttaccaccatatatattgaaccgatgattggtataagcattgtcgacacaactgacaccgctttttcgtttactgaccttgcaaccattacgaaatatgacacaatcataagcacagcaatcacgcaaagcgagcgacacatgaagttagacagtcctttgacatccacattctttttttgctcagcagtcattgtgttatagcccgctatgaggttgggatatttccttacgagcattcccaatacaaacagaacagctgctattatcaacactggtgtctccatttatatgatacttaaaacataaaactgaacactttcttttgcgaaactttaaacctttcaatctccaaagaaagcgatttcttcaactgccctgccataaacgacaaaaacggctggttggtttcttcgtcctgacattggcgtagagaaaggatatattcttccctatcctctttgaatatcttagtaggaaaaaggtgataacaaaactggatgtagttcatcagtaatcgaactgttctgccgttgccatccacccacggatgtatggttactaaattaaggtgggcattaaaactcaattcatattgttcccgaaatgctcccacggtcttttgcttctcttgcagaatcgcacaaagttcatccaccttagcaggaactttcagatagttcatgtaagaatgtccgccaacatcagccgtaacaccacataagcgaaattctcctttggaagaatcgaaagacccttgtaaagatattacctgcaaagtggatagtcagatgcttcggaaagatgtgctttcgcccgaagaagtacaaaagctgatggcttgtcattatgacaacgaaaaccctacagtcagacaagcgtttatcttttgcctatattgcggtctgcgcttctgcaatgtaaaagatcttacttttaaaaatgtggattatgctaaccgattattgaagttcgagcaaagcaaggccaaggaacattctgccagtagtggtgtggttattcctttgaatgacggtctattgtctatcattggtgaagctccgacagataagaactgtttaatattcgatttgtctacatacgaaagctgctgtaaatctgtaaagcgttgggtaaagagagctgggatagacaaacatataagctggcaccttgctcggcattcgtttgccgtgaacattttgaacaatggggcaaatatcaaaaccgtagccagccttttagggcatagcggattgaagcatacggagaaatacacccgtgcggtggataaattgaaagaggaagcaataaacagcttacccgaattaaagttttaaccacaaaagacttatctttgtaactaacgtgagttcgaaataaaatcaaaaaatagcaagttgtccgtcattgacaaactttacgtcaatggcgggcttcttttcaaaaaagcagtatgccgcgatagccgacaaggagttggctataaagttactgaatatatcagggaggcggcactggcggccaccgtgacggcaaggcatacgcctgaagaaaatgcattgctgcgcagcctggcgggaatggcgaacaacctgaaccaactgacaaagctctcgcaccagacaggcttttacagaacaaggctgctgatagaggggctgctgggaaagctgaagcggatcatggatgattacagacctaaagaaggatagcctcatgatagggaagatcaggaaaggccgctcattcggcggctgcatacgctacgtgacgcagaaggacgacgcggaaatcatcgcctcggaaggtgtgctgctgggaacggcagaagagatggcgcgaagtttccgatggcaatgcctgctgaatccggacgtggcgaaaccggtgggacacatcgcgctcagcttcaagccggaggactcaccgaggctgaccgacgcgtttatggcaaggctggcgggggaatacctggaactgatggggatacggaacacgcagttcatcgtggtgaggcatcacgggacggacaacccgcactgccacatcgtcttcaaccgggtggacttcgacgggaaggtgatttccgacagcaacgatttcaggcgtaacgagagggtgacaaaaatgctcaaggacaagtattcactcacctattccgaaggcaaacagtccgttaaaacggaaaaactgcacgcttccgaaagggtgaaatacgagatataccgtgcggtcaaggaagctttgaggagtgcagatacatggaaggaatttcaaaataggctcttaaaaatgggcgtggaaatggaattcaagtacaagggaaataccagtgaggtgcagggcatccgctttataaaggacggtctgtcattcaagggaagtgggattgaccgcagtttcagctggtcaaggctggatgcggcattggagcataaccatgtcacgtcccaggaaaatgacgtttcccaaaagcaaccgtaccatgaacaaagtcatggttctgttattgataacctggtcgaagtcaccggtacgggtggcgtgttcatgccgtcggtggcaccgacggaggacgagaaagaggcggaacgcctgcggagaaagaagaagctcaggaaaggaaggagtttgtaaactagtatgtataacgaaaaaactttgaaagatgaaacaggaaaactatctggaaggcatctacggatgccttgaaaggatcgagaagaaagtggaggcgctgcccgtggaaggcacaagccccgcagttgaaaaccggaccagttccccggaagggattacggaactgaaaatccgtctggaacgcctgcaatccgcagtggagaaaaacagttcggaaatagcagcggtacgtagccataccgcccggttgtcggaaggcaggccgttgtctgccgaaacgtttgccggagaaatggaaaagacaagggacagcctgcggcaggacagccaagctgtaaaggaaacggtaagacggctggatgagagaatggtcctgttgaaaaaggaaccggagcacaaactggtgacctaccgtctggaaagcgcatccaaggcggtggtaacgacagcttcagcactgatcctggcactgatcatttccgtctgggccaactgtaaccagtaccgcacgaaccggcttttgaaggatgccgatttgaaataccgtgccatcaggatctgcctgccgggggatgatcccgacatcgctttccttgagaaacatttcaccatcgagcgggacgaggaaaagatccggcgtgtggaaaggctggtgaccgcttttgaggactctgtcaggaaccgcatccgtaatcatgaaatggcggcctacaaggacagtctggcgcaccggctgttcaaggaggcgcaggaaatcaggaagcaactggacaatcctaattcaaaatgactgcactatggcaacaatcaaaaccaaattcaggtcctcgtccgtggaaggcagggaggggacgctctatttccaggtcatccacgaaagggtggcgcgccagataaacaccggttacaggctgttcccttcggaatgggacggacgcacgtcggaaatcatactgccggtatccggtgattccagaagaagcctcctgcttgcgttaaaggagcggatggaaaaagacatccgccgtctggaaagtatcattgccggactggaacgttccggcggtacctatcccgccggcagggttgtcgaactttttcacaacccgccccttgaggacagccataatttcatggccttcggaaagaggctcgtggaggaactggagcgtgtcggcaagaagcgcaccgccgagaggtacaccaccgtactgaacagcttcacgcacttccggggcagggacggcgacatcccgctggaggatatcggctccaccctcatgctggaatacgaggcatggctgaaggataaggggatatgtccgaacagcacctcctattacatgcggaacctgcgtgccgtctacaaccgtgcggtggacagggaactgacggtacagcgcagccctttcaagcatgtctacaccggaatagacaagaccgtaaaacgtgctgttccattgaaagcggttcgcatgatacgtgacctggacctgcgtctttccccgggcatggaatacgccagggacatgttcatgctgagcttttatacccggggcatgtcgttcgtcgacatcgcctacctgaaaaaggctgatctgaagggcggcgtgctgacctaccgcaggcggaagaccggccggcgtctgtccattaaatgggagaagcccatgcaggagatcctggacaggtatggccacaatgacagcccctacctttttccggtcatcagggatacggccaaggatgccgtgcggcagtacaggagcgcagcgcatttcatcaacggaaaactcaaggaactcgggaaacggctcgggctcggtatgccgctcaccatgtatgtagcccgacatgcatgggcgagtattgccagaagcaagaatgtgccgctggcaaccatcagcgaggcgatgggacatgattcggaaaacacgaccagaatctacctcgcctcgctggatacctcacaagtggacaaggcaaacgacatcatactcaaatccttataacggggacggatgcggcacgcagaataccggacaaaggctgtgccgttcctgcttctctttttaagagaaatattacacattgcaaagataatcaaaatatgggaaagcacccgtccgtatgataaaaaattgttttctccaaaggaaaatgtttcaaataccggtatgattgttgaacagatcactttcaggattcatatatgattctgattgtcagatgctatcccttcccgatatttctcttaaaaagaaaagtaccggaaaagatccatgaactgtcaatatagcggcaggataccgttggagatattcttattgacaatttaaaatcggatgtttttaaaaatggatttttgaaggcgttttgtaatacaataaaaattgttgagcatacggctcgttttcttggcaagagaattattacaatgtgcaaagttacgtaaaatattgaaaaaacaatagaaaacgggtaataaaattaaccaaaacattcatacagagtgtatttgcttaacatatgtcggataagtaccataatgccgttccgtatttctatctgtccgtcagtcatttacgtaaaatatgatccccggatatttctcttgccaagagaagtagcggcagaagccccggaaatgaggtctgtacactttgtcaaaagtatgggactgacagtggatattataaataaaggaaatgtaatccgttgtaatacataccaatatacgaattggcatgaactaggggtatatcctcacctataaaataatcccggcaatatgggtatgagtttttctacggcggaagaaaaaaagcaggtccgctggttcgtcatgcgcgcctacaagaatgagaaaatggcggaggacaggctgaaggacaaggaatacggtctggaatatttcattccgaaacattacgccgtaaagacctatcacggggtgaagtcgacaaggctggtgccggtcataccgagtctggttttcgtccacgccagccattcgcagatcaccgaattcaagaaacggtacaacttcctgcaattcgccatgtggaaaaaaagcacgggtatggaatatatcaccgtgccagacgaccagatggacagtttcatccaaatagcttccctgtatgagaaggatacggcctattataagccggatgaaatcgacgtacggaaaggtacccgtgtatgtatccacggcggcaagcttgatggagttaagggtgtgtttatgcgggtaaaagggaaacgcaaccgccgagtggtcgtgatgcttgaggggattatggggatatcggctgaggttcatcccgatttgattgaagtcatttcctgatatggaaaagtctggaatcctcattcacggttttacgcaaataaaaaacaatatctgaatatatgtatttttggattgtaaattgttcactggcatttttgctttgtgttctctgtgcgggtatcgtcattccccagattctgctaatcgcttttcgcaaacagctgttcgaccttcccgatgaacggaagatacatcattgtgcggtgccccgattgggtggtatcgcattcaaaccggtcgtgtttttcaccatagctttgttactgggaatcaatatggcactggggcattcggaaatgttgtctgaaatcggaaacaatgtacggcctttggcttttgctttctgttccatcatggtactgtatctggtcggcatggccgatgacctgatcggcatccgttatcgagccaaatttgtcatccagatcctgtgtggcgtgatgcttatcgccggtggaatatatatcaataacctgcacggcatcctaggtattcatgcggttccgttatggctggggtatcctttgaccattttaatcgtggtcttcatcatcaatgccatcaacctgatcgacggcattgacgggttggcttccgggctatgcagtgtcgcctgcctgttttacggtctgacttttttcatgctccaccagcatgtctatgccatactggcgttcgccacattgggagtgttggtaccgttcttctattacaatgttttcgggaacgccgagcacggaaggaagatcttcatgggtgacacaggtagtttgaccgttggcatgatgctctgtttcctcagtctcaaactgaccatgtgcggtctagacgataatacaggaaatgtacatccgatggtgctggccttctcacccttgctggttccatgctgcgatgtggtccgggtctacctgcatcgggtacgcaacgggaagaacccgttcctgccggacaagaaccacatccaccataagctgcttgctctcggaataaagcagcgcaatgccatgattatcattgtttccgtatcaacaatattcatactgctcaatattcttctgtccctttatctcaatgtgaactggatcgtgctgggcgatatcctgatatggactcttgccaacatcaggctgacgaaatctatcggacaacttcaatcggaacagaaaaccaacaaataaaaatcaatgaaatatgaaaatcagatacattttattcttattgaccgtggctttcctgctgggatcatgtgccacgccgaaagtcgcttatttcacggacctgaaacggggtaccgcagaacaagtcttgaacccgctggaaatccgggtgcgtcccgaagacaagatctcaatactggtcaacagcaaggaccccttgttgatgaaccttttcaaccttccgatcatatccagacagatcggtacgacatcgggaacatccaatagccaggggatatcaggatatacgatcaacaaggatggagatatcgattttccagtgttggggcatatccatgtggcgggaatgacacgcgaggaaatcgcctcgtatataaaagaggaactggtttcgaagaatctcgtgaaagaccctgtcgttacagttgagttcatgaacctgaccgtttccgtgttgggtgaggttgccaaccccggacgtttcaatatcgacaaggacaagctgacgcttttggacgctttaagcatggccggagaccttaccgtctacgggaaacgggagaatgtcttggtacaacgggaggaaaacggcaaacagaccttgtatcaagtcaacctgaattcgggatacgacctttatgcctctcctgtgtattatttacagcagaacgatatagtttatgtggaacctaactcaatgaaagcacggcaggcgactgtcaacggcaataacgtccgttctgcttctttctggatgtcattggcctcgctgctgactaccattaccgtattaattgtaaaataaatataaaatcagatatggccataaatcaaaagaatacaaaaccgggacagccggatgatttcctgcggatacaggacctgttgtatctgtgtctcgcaaggtggcagtggtttatcttgtctttggcgataacggtcggtgccgctaccgttcatctgttacgtacccctgccgtttatacacgtaccgcttcggtattggtcaaagaagattccaaaggaaagtcggtttcctcggatctggaatccttctcggagttcgggttgttccaatccggtacaaatgtgaataacgaacttatctcctttcagtcaccgtctttaatgaccgaggtggttaaacggttgcgtttggatatgaattacttcgttccagggaaattccaccgtcaggtggcctatggactgacattaccagtggatgtaacgataaatgacgtgcctgaaaatgaatcagccggtttcacgctggaagtgcagccggacggcacgttattcctgtctgactttatacgtaacgggacggatcttgacgaaaaggatataaagggaaacttgctcgactccattcctacaccattgggaaaaatcattatccatacaacacccaattacgtgaaaggcaaggcatatacattatatgtagacaaatccaatttgtataacgctgtaaactcctgctcatccaatctgtccgtttctttgaataacgagaaagcgtcggttatagacttgtcattcaaggatacctccacacagcgggcggaagatatattgagcatgttgatttccgtttataacgagaactgggtgaaagacaagaaccagatcgctgtcagtacctcaatgttcatcaatgagcgtctgggagtaatcgaacaggaactggggaacgtggacgaggatatttcctcctacaaatcagaacacctgttacccgacgtgcaggcggcatcgaacatgtacatggcccaaagcagtgcgaccaacgcacagatcctggccttgaacaaccagctttacatgacccgttacatccggaactatttagccaacgatgccaaccgtacccaactgcttccgaccaattccggtatagagagtgccaacatcgaatcgcagattgccgaatacaacaaacaactgttacagcgtaacagcctggttgcgaacagcagcgcagaaaatccactggtcatggatatggatcaggctctggcatccatgcgtggggcgataatcaggtctatcgacaatcagatagtaaccttgaattcgcagataaaaagtttacggcagacggagcaacagacaacatcacgtatagcagccaaccctacacaggccaaatacctgctttcggtggaacgccagcagaaggtaaaggaggccctttatttgttcttactgcaaaaacgtgaagaaaatgaactctcgcaggcatttacggcttacaatacccgcattgtcaccccgccgcacggtagcatgttgccgacatctcctgtatgcaaaaacatctttatggccgcgtttgctctgggactgctcattccggtagtcattatcttcatgcgcgagaacatgaatacccgtgtacggggaaggaaagacctggagagtgtgaccgtaccgttcatcggcgagattccgctgtttacaagaaagaagaaagggatattcggaaaggaaccgcaggaagtcaaggccgttgtcgtcaaggagggcaaccgtgacatcatcaatgaggcgttccgcgtattgcgtactaacctggaatttatgaccggcaaggacaagacttcgaatgtcatcatcatgacctcgttcaatccgggcagtggcaaatcgtttctgaccatgaacatcgccgtgagccttgccatcaaaggaaaaaaagtgctgctaatcgacggagacctgcgccacggatctgcgtcatcctatatcgactctcctgccaagggattgagcgactatctgggaggtcgtatcgataatctggatgagatcatcgtacccgatccgaaacataaatctatggatatactacccgtgggaacgatacctcctaacccaacggaattattgtttgacgagaggctaaagcagacaatcgatactgtaagagaacaatatgactatgtgctgatcgactgtccgcccgttgaactggtggccgacacgcagattatcgagaagctggcagaccgtaccattttcgtggttcgtgcaggattacttgaacggagtatgcttgctgaactggagaaaatctacgaggagaagaaatacaagaacatgtccctgatcctgaatggaaccgagggaagcggtggccgctacggataccgttacggctatcggtatggttaccactacggctacggctcggaataccactacggctccgatgagaaacgtgttggtgttgggtgataaataactggttgtcaaataattagcaaataagtatttcaaataaaatcttcatatcattgtgtggcctttcagaaaacgcatcccgctgaaagatagcggcatattcgagggttttaccgactggcactcgcacatcctgccgggtgtggacgacggggtgcggactgtggaagaagcgttggaaatactgcgcctgtatgaagagttgggcataaaatccatatggcttacaccgcatatcatggaagatatgcccaacaccacaacgcatctcagggagcgttacgctgaacttcaagccgcctatagcggacggataaaactacatcttgcctccgagaatatgctcgacaacctcttcgaggaacggttggaaaagaacgacctgctgcttttgggtgagagcggcgaccatctgctggtggaaacctcttacttcagccctccaatgggattaaacaacattctgctccgcatcaaggccaaaggctactatcccattctcgctcatccggagcggtatgtttatatgggtgaatcggattatcgacaattaaaaggcataggggtgaagtttcaactcaatctcttttctttagtcggtgcatacggcgtggaaacaaaaaagaaagccgaatggttgttgaaaaacgatttttataatttaatgggtagcgatatacatcgccttgctctttacgaagaaatgataagaaagaaaatgcaaaaaaatatcttggaacgattgaaagacctttctaaataatagaatatatgaaaacttataagattgcagtagccggaacaggctatgtcggattaagtattgctacgctattaagccagcatcatcatgtaacggcggtagatgtcattccggagaaggtagcccttatcaaccagagaaaatcacctatacaggatgactatatagagaaatacttggctgaaaaggaattatacctgacagctacccttgatggtaaaacagcctatcaagatgcagactttgtggtaatagccgctccgaccaattacgacccagtgaaaaactattttgataccagccatgtggaagaagtcatagaactggtgaaaagcgtgaatcctcgtgccattatggttatcaaaagtacaatcccggttggctataccgagaatatacgcaagaaactggatacggaaaatgtgatattctcaccggagttcctgcgcgaaagcaaggctttgtatgacaatctgtatcccagccgtatcattgtcggtcgaccggaaggagataaacgcttggacgaagcagcccatacttttgctgctttgttacaagaaggcgcaatcaaagaaaatatagacacccttttcatgggacttaccgaagcggaagcggtaaagctgtttgccaatacttatttggccttgcgtgtaagttatttcaatgaactggatacatacgccgagataaaagggctggatacgcaggccatcatcaacggggtaagccttgacccacgaatcggtactcattacaacaacccgtcattcggttatggaggttattgccttcccaaagacaccaaacaactacttgccaattatgcagatgtaccagagaacctgatacaagccattgtagagagcaaccgtacccgcaaggatttcattgctgaccgtgtgttacatatggcaggttactatgactactataaccgtggagattttaatcctaatgacgagaaacgatgcgttattggagtctatcgcctaacgatgaagtccaacagtgacaattttcgacaaagcagcattcagggagtaatgaaacgtattaaggcaaaaggagcagaagtcattatttatgaacccacgctggaggacggtagtactttctttggaagtaaagtcgtgaatgatattgaactatttaaatcaaaatctcaggttattatagccaatagatacgatgattgtttgaatagtgcaaaaaagaaagtatatacaagagatatttttagcagggattgataagttttgatgtgtgggatgaaaaacttttagcatgagcgacatttccgttttaaaaaaagaaggactcaaaggtagtgcttggaatttcttgaatatggctgtcaaccaaacgagaaactttattgtttcattggttctcgccagattactaatgccttctgatttcggtttgattagtatggcgttggtcttaaataccatacttgactctatcgttgattttggattagggaatgcagttatacgcaaagagaaaattacggaaacggaattatccacagtcttttggattaatattctgttaggaggattttgtacattgactgtttttctttcagcccctctctttgagtacttttttgaaatgccacaattaggtaatattgtaagaattacttccttttctttccttatcagttcatttggaactttacaaacagccctttttcagaaaaagttaaactttaaagccccctttattgcaaaactaatttctggccttatttcaggaattggaggtataatattggccttattagattttggcgtatgggcattagttttttcaaataccgcaggttggctttttaattcgaccatactatggataatctcttcttggcatcccaaaatgctttttcaaccttctcaagtcaaagaactttggaattttggatggaaaatgacattgaccactattataaatagagtatttagacaattagacacatttatcattggtaaattatacagtgcggcctctttgggtctattcaatcgggctaagtctttaaataatttggttatagaatgttctttttctgctatccggagtacaatgttaccaacattcagcaaacttcaaaatgatgtggaattgttacgtaatagcattataaagctcattcatgtgatttcattcctgacctttttatttgcaggtcttatgtatatgtgcgctgacgatttaattataatactttatggaaataaatgggaaggagcaattgagatatttaagattttaggcttgttttctattacaatttgcctccctgtagtctatgatgctattatttcagtagtaaatcgtatgagtttatatttatggataggaattattcggaatatgattttattaatagccataccctttgggattatttatggttttcatgcttatatatggagtgtatcaattgcatcaggaattaatttaattccttacttttttgcagcaaacacctgcatacaattacctgtagcatcacaaatatacactattgtacgatatgtggcacctttcatttttgctatattactatggcagattatagactattcaagtaggaatcattttattgacatttttttgaaatccatttattttttatgcacatatgtaggatataatatgtgggcgaaaaacaatggatatgtaatctgccaaactttaatcaaaaacacagtggctaaaaataagaaatgatgaatctactttgcaaaatttatcgcaaacttgtggaaactcattggtcctatagaaaaaaacattcacaagtaagaatacaaacaggaggaattttccgggtcggaaaaaatgtaaggattcaaaagagtaccatttatgtagacagtacttctgaattaattttagatagtcatgttcaattaattggcgtaaaaatttttgtaacaaaaggatcgcatgttcatatcagtgagtattcttgcctaagtcagggaaataatattgcatgtccattgtacacaattagccaagggaaactaatagtggatcatcatgtttatttacgacttcaaagactgtggatccgttttgggggatttattcacatcggacaatatacaaatataaataacggcagtgaaatccgttccgatgagcgagtagaaataggtagttattgtatgctttcttataatcttaggatttgggatacaaatacacactgcatctatccttctgaaaaaagaagaaaattaacacgtgagaagttcccaaattttggcgctgaatatgaaaagcccaaaacagcacctgttataataggtgatgatgtttggattggtgaaaaatcatccatattgaaaggtacatcactcggtaacaatgtgatagtcggatacaatacaacattagtgaggaaacatattccaacgaataaaacagtagtacaaaaaatagaattatctatcatataaattattacatgtcaccaaaagtttcaatacttattccctgttacaattcagagcgatttgttgcagaaactcttgatagttgtctcgctcaaacttatcgcaacatcgaaataattgtcgttgatgatggctcaaccgacaactcatttgcaatcgcaaaaagttttgaatccaatatcattaaagtgtatcgacaagataattccggtgcttgtgctgcacgtaattatgctttccgtaaaagttccggtgagtatatcgtttatttagatgctgatgatattattaatccttcctttgtagaggaacatatcatacgcctatgcgatgcaaatgaaagatgtataagttttgggaaatgggataaatttagatcttctatagcagaaacgacattcccatctcggcatttttataaagactatatagcccctttccaacttttgattgatttatgggagacaggtagtatgttacaaacatcatgctacatggtatcccgacagcttgtctacgaatcaggaggttggaaagaaaatctactcatgaaccaagatggtgattttttttcgcgcatattaatgatagcctcaaaagcatattttatatccaatgctaaagtttattatcgtataggcgaatactccacagtaagcaaagcaaacagtgagaataaattagtgtcattacttgatagctatatcagttataaagaaaacgcactcattcataaagataatttacgagtacgtaaagcattgagttataacttcacgtattttatttatctatatggcaacaaatatccagccctatataagaaagcgaaagaccaagtggagaacttaggggttggatttcaattgaggaaaaaatcgccccggataaggttcgtaagcaaaattttaggttttgaaaatttaatggctatacgaaggattatatcaaaagagtaaattatgcaacaactaagtcagcggaaaataagcattatcgttcctgtctataattcagagaaacatctttgcaaaatgatagaatcaattatcgaacaagaatattcccactgggagttgatacttgtggatgacggttctaccgacagaagtggagatgtctgtgatgaatatgcacagaaagatactagaatcaaagtatatcatcaaaaaaacggcggagtatctgtagctcgcaacaaggcattagacaaaatttcaggcgactatgttacatttattgattccgatgattgggtagaacctagctatcttttacgctttatggagtttccatatgcagatgaccaaatagtctttcaagggtatttcatggactatgtaggagcagtagcgaaggagtcaacaaaggaaatccctaaacaaggccgaattttacacttaggggctattttgggaaaaatgtttgctacaccaatcattaagttgcataatattcgatttgatgagcggttacgtttgcacgaagaccatgtattttattatgaatgcttgaaatatgcaaggcagtttgatttttcctcatatgcgggttatcactacatgcattatggagaacaatccctttctcgaagattacagtcaactgatgcctattttcttgcatcagaattattattggactattaccaatatgacatcacagtttcagataacgaatataaacgcttctgtattcaaaaatttggtctaaaccaaatggtaatgggtgtgttttcactctatttttcatcgttcactaaaaaacatcgtttagatgtattacgaatgataaaaaaatatgtcgaaatatttaaacaattttacgttcctaattctttaaatggaaaattgtttttattctgctatttacatttcacacctgccattcaagatgcaatatttaaaatagccaccgcattgttaggcagaaagtttaaaactcgactgaatctaaaataatctttttacatacagaaatgactacaaatacattaaagttttttactttacttcggtttccactaatggtgggtgtggtgatgattcattgcgacatatccgaccagcttgtgcctgagttacgtgggcaatgggcacaagatgtaatgtatttctttagcaatataataggtcgatttagcgtaccaatgttttttttaatttcaggatttttattctatcggaatggaacactaacacacaatgagtatgcatctaaattacatcatcgactatacacacttcttataccctatcttttatggaatctgatagcttttttatttttcatagcgaagcattacccccccctatgttccgtttttcaaggaatcacggaaattccaatttcgtttgaaaattttctaaaatcattttgggaatttcgatttgaaggattaggagaatctaaatccatgcctatagatttccccttgtggtatgtaagagatttgatgattgtagtactttgttcacctctattatgcaggctcattaagtgtggcagattattagtaggattaatcgggggtatttggctgagctttaaccctgagttttttggcatagatatgactggatttttctttttcacattaggcggttatttttctatgaacaaggttgatttagctgatatttttaaatcaagaaaagcaaaaatatcaaccatgtttctttttgtcattgtaattatagcagatatgattacccgtggggaaacttatcattatttgctacataatatcaccattttaacaggcatgattgtaatgtttatatgtgctgatttaatcctaagactaagcatcggaaaatctacgattttaatagaacatttcgcttcgacaacattttttgtatatgccttgcatggcctgtttgtagcacctttgagaaagggactttgtctcgcttttacaacgacatcaaataccgtagctgttatgacttatatgctaagtatattaacaaccattatattgagtcttattacttattacgtgttaaaaaaattatgcccacaattctgtagtttactcaatggtggaagataaatgaaacttgtaagataacccccaaatagaaacaaaaatgaaaatcgcaatatctggagattgcttgagtgtttttactagtgcatatcctgtcagaggtatgctgcttgaactaataaaacaacgtcaagatgatttatttatcatattttatactcaaaggccaagacctaaaatgttaaagtctttttttgagcaattacatgcactcccaaatgtaaaaacacgctattttaaatggaatagatatgtcgtaggtttacagcgtttccttactctatcaaactattttccaatagataacagttacgatatttttataaatccaagctatttggaatatgtccgagcgttcaaaggtgtgcaaatagccaatataacagatttgtccatactccattcccaagcatctattccacatgcaaaaatatggaagttacaaaacaaatttgcaaaatctttctatttcagattgaaagatttgaatgtggtttctatatctgaatacacgaagcaggatattcatagatatttcaagagagtaaatacccgtatcaatgtaatttataatggtattgatgatttttggtttgacaatcactatatcgaaaacagtcttaccaatcaataccagaatcgagcctattttatttggtggggattcatgtcccgcagaaaaaatttgatcaacatgttattagcgtatgaggaattggtgaaagagaaatgtgaggttccagatatgcttatcatcggaaatatagcggagcatcttaaaaaagagataactcccctaatggaacgaaatgccaagattatccatttgcctttccaggaagaatatgtgctcaaaacattagtaaaaaacagtaaaggacttatatttccctctttttacgaaggatttggattacctgtcattgaagcatactcacaaggtgttcctgtcgcttgttctaatgtaacttccttgcccgaaattgcaaatggcttcagctttctatttgacccgaataatcgaatagaaatcaaagaggcttttcttcatctattgaattttaacaaagaaagcaattcacctttgttgatccagtatgcccggcaatttacatataagaaagccgcagaagcctataataaattgataaataaaatggtatgatttgggaaattatacgttatggaatatttgccttgtttttatgtctgacatgcttctttgtatataggcagaaacatgagtatcttttatggttgtatttctttacatttccatttcaaaactgtgccttttatcttataactacatggaatccgtacaaggtcgttgccataggtatgcttttttgcatactgtttcacccagcaaacagtcggacttcggatgtacttaaaaggattgttgcatacttttttatcgtgctattacttagtaatctgttttcgttactcatgcctcctgaaaatgttggaacacgcactttgattcgcctattggttcaagatgccacttacatattaggagtcgttccattattattcatgaaccggcttccaagagattttgatcaaagggtcataaagtggtacacgtatgccatctgtacactgataggaatagggtttgtacattatttctttcttaaagcaggcattccatttgctcccatcattcgcgatgtaggtacgtccaatgctgttgcagccactttttttggaggtgatacagtctttcgcatatatggcctttgtggagaacctaagaatatggctttcgcattaactccatttgtactttttctaataacaaatttcctctacaaaaagaaattggatctgaaagcggcaaccatattggctttgggattatttattttattaaacacgttttcttctgccgcttttattgaatttgcgattggactaattggtgtagtgattttaatattatcaagaactaataagttagttgcaatactgactatcagtaccgtattagtgataggctctttcggactattcctttcagaaattcaaaaaacgcaaccaactaatgctaaaaccgaaatctcttttattaattctttttatgaacgctcttttggacgtgcccaaaatgaaatcgaggatggacggtcagaggttttaataacaaaagattttatagaatcctataatcctatttactatttattcggatatgggccgggacaatattctttccatagcaaaaatctaacattcagtggcggatatattccagttcaatcgggattggtcctgaacttagtggattttggcctcattggatatttgtttttcttttatttgctatatcaagtatatactttatataagaaatccaaatccaatgatatatcattctattttatagtcataggctgctgcacaatgattggaaatttcatgtattcaatgatgggaggaagtatcctgataggtatgcttccttttataggcattgcatttcaatcataccattataatacagaatatgaggactaagttgatcctttagatatgcttgtttcatcgccttttaagaaagatctattctttctctatctctgtaaactccaaggttcactacttgcctcctttgtattcttttgccattcgcagttaaattaatattttttatctcttaagcatatgatgaaaatacttcattcaggaactcttgatataaaatacggagggccagcattaagcacatatctgaccataaaaggattacaagctaatcaggtaaatgcagaaatgcttatggcccctctaaccaacaagaaagatttaatagccaatgatgtgaagatacattatacttcacctactttggaaactcgctttggatacattccatatctaaagacctcattggaaaatatgcccttatatgatttataccatatacaagggctatggttatatcttggacacggagttgcaaattttgcccgaaaaaagaaaaagccttatgtcattacattaagggggatgctttatccgcaggccttagcgcactctaaacagataaaacaactgtctttgttgttgtatcaacgggaagatttacaaaaagcagcctgcatacaagctacttgtcttgaagaaatgcaccattaccgtaatatgggtttcactaaccctgtagcagttttacccaatccaatagaaacagacggaattattgaacgccctattgtccaaagtgataaaataagaatcgggtatttaggacgagtacatccacgcaaacgtattgaaagattgatttacgcattcagcatattacgaaaagagatgcaagataccgaattacttatcattggtgctgatgatgaacaatatgagcaattcttgaaagatgaagtcaaaagacttaaattgacaaatgtccgctttacaggttttttggcgggtgtagaaaaagacaacgcaataagttcattaacttatttggcagtaccaagcgactttgaaaattttggaaatattgtcacagaggctttagtgagaggaataccagtcattgcttccaaaggtatgccatggcaagaactggaaaaataccattgtggttggtggattagtaatgaccaagaaactataaaccaaacattactcaaggctatccaaacgccacctaatgaacgtctacaaatgggcctcaatggtaaaagaatgattcaagaaaattattctgtaactgtactcggagataaaatgagccaattatatcaatatattctccatatatcagaaaaacccaattttgtgtatgaatactgatttatcccactatgataattcttggtataatccgggaaaaggaggattcatacgaattgtctggtattttataaacgtcctgttttttataaaccctctgaatccattttcctgcataaaagtaagactgttgcgattatttggtgcgaaaatcggaaaaggagtagttattaagcctaaagtaaacataaaatacccgtggagattggaagtcgggaactacacatggatcggtgaaaacgtgtggatagacaatttggcaaatgtaaaaattggaaataatgtttgcataagtcaaggagctatgttactttgcggaaatcacaattacaagaaaactacttttgatttaatcattggaaatatcacattggaaaacggcacttggattggggcacactccattgtttgtcctggtgttactttgcactcgcattctgtcttaggagtggcttcggttgccaatcacgacatggaatcttattctatttatcaaggaaatcctgctaaaaaaatcagaataagaacggttttttaaatcaatatatatcctttatgaaaatcagcattataactgctacattcaatagcagttccaccctccgtaacaccattgaaagtgttttaggacaaacttatatggattttgagcatctgataattgacggaggatcaaacgacaacacgattgacatagtacgagagtatgagccaatctataaaggaaggttacgatggattagtgaacatgatcgtggcatctatgacgctatgaacaaaggtattgcaatggctacaggtgacattgtgggcatacttaatagtgatgacttttacacttcttctgatgttttggcaatggtagcaagagcaatgtctgatacaaatttagatgccgtatttggagatgttcattatgtgaacgattgtgatttgaataaatgcgtccgttattacacatcccggccattccatcgaagttggatgcggtttggtttcatgccggcacatccgtctttctactgccgacgttcaatatatgaggaatttggaactttcgacttatcgtataaagtcgctgccgattttgaaaatctgttgcgcctgatattcatacaccacatccgcacccgctatatagccaaagattttgtaactatgcgtataggaggtgcatcttcttccggctttcatagccataggcaaatcatgcgtgatcatttaagagccttgaagcaaaatagggtgttttctaatcctctattcctgtgtatgcgttatccttacaaggtgtgtgaaatcgttgtaacgaaaataaataacatatttcgatataatttaaaatgaaagctcttattacaggcatcaccggccaggatggttccttcttggccgagtttcttttagcaaaaggttatgacgtgcacggcacgatacggcgttcgtcggtagacttccgtgagcgtatcgcccatttggaaggacatcccaattttcacctgcattatgcagacttaggcgactccatgagtattctgcaagtagtgaaaaaagtaaggccgaatgaaatctataatctggccgcacaaagccatgtgcaggtgtcgtttgactcaccggaatttacagcggatgtggatgcgactggtgtattgcgtatcttggaagctgtgcgccaatgcgacctgactgatacttgccgaatttatcaggcttcaacgtcagaactttacggcaaggtggaggaagtccctcaaaatgagaacacccccttccacccttatagcccgtatgccgtggccaagctctatggttactggattgtgaaagaatatcgggaggcttacaatatgttttgttgttcgggcatcctgttcaaccatgagagcgaacgccgtggagagactttcgtcacccggaaaatcaccctcgctgccgcacgtatcgcacaaggcaagcaagagaaattgtatttgggaaacctctcttcattgcgcgactggggatatgccaaagactatgtagagtgcatgtggctgattcttcaaaacgaaaagccggaggacttcgtgatagctaccggtgagcagcattccgtgcgcgagttctgtcaattggctttccggcatgccggaatagaactgcgttttgaaggagagggagagaacgaaaaaggcatagatacgaaaaccggcaaggtgctggtagaagtgtctcccgacttttaccgtccaaccgatgtagtgaatttatgggggaatccggcaaaagctaaacgagaattggggtggaatccgcaaaagactactttcgagcaacttgttaaaatcatggtagatgcggacatggccaaggtggccgtggagcgtgccggagagcatgtacgcaccaacttggaagaatatctggagaaaggaatcgtaaaatgatggaaaagaacgcaaaaatctatgtggcaggccaccggggaatggtcggctctgccattgtacgtgaactggaacttcaggaatacacgaacatcatcacccggacgcacaaggaacttgacctgacacgccaagaagcagtagagcgtttctttgctgaggaaaagccagaatatgtgtttcttgctgcggccaaggtgggaggtatcatagccaaccaatctgcattggcggatttcatgtatgagaacatgattctggaaatgaacgtcattcatgcagcttggaaaaacggttgcaaaaagttggaatttctcggttcgtcatgtatctacccccgtatggctccgcagcccatgacggaaagttgtctgctgacaagcgaactggaaaagaccaacgaggcatacgcactagccaaaatatccggcctgaaatattgtgagttcttgaaccgtcaatatgatacggactacatcagtgtaatgcccactaacctttacgggcctaacgacaactatcatcccgaacatagtcatgtattaccggccttgatccgccgtttccatgaggctaaagaacagaggcttccctatgtgacctgttggggtgatggcagtccacttcgtgagtttctgtatgtggacgaccttgccaacttgtgcgtgttcttgatgaataactacagcggtaatgagaccgtaaacgcaggaacaggaaaggaactgactattaaagcccttactgaacttgtggccaaaattatcggttacagtggtgaaatacgttgggatacgacccgtccgaatggaacaccgagaaagttactcgatgtgtcaaaggcaaccgctttaggttggacttacaaaaccgaattggaaaacggcatacgtcttgcctacgaggattttttgaataatccgatgcgggcggagagataaaaaataacataaagtggtgactatagcgatagggaatacacctcttcccattccgaacagagaagtgaagactatttgcgccgatggtactacatttagtggaagagtaggtaatcgccaaagagagataattcttttttattaatagtaaagtatctgaaatatgaaaaatatttttagtaattagggcagcctctcacgttggaggacgaggctgtcagaatggatggtagcaatacttcttacccttgctactgtatagatgtcttatgatgtctattagtcctatgtcgcataggatgaaacagagcggttcgctgcacagttgaatgtatatggattatacgataacttaaaaagtaagcgagaacaggatgaactacttgaggtttggaaaatctaatcttccagtgggtttgaaggatcccaccaaaaaaatccttcatttttcatttactgatatagctttcaaagatctatatgcaaatcatactgttatccggcggctcgggcaaacgcctgtggccgctttccaataatacacggtcaaagcaattcattaaactgctgactgcgcccgatggctcgaaagagtcgatggtgcaacgggtggtacggcaattacgggaaaccggcatctgtgattcgattaccgtggcaacaagccagttgcagcgggatgtcatcatcaaccagcttggagaagagattcctgtagttacggaaccggagcgtcgtgatacattcccagctatcgctctcgcaagctcgtatttggcctacgaacgaaaatgttccaccgatgagattgtaatcatcatgccttgcgacccttatactgaagctggttattttgatacgattcgcaggatagcggatgcagtgaaaaacaatgtagccgaactggtattgatgggaattaaacccacatatccgtcagcaaaatacggatatgtagtgccagccaatgatgtacaaaacaaaggaacatttcaagtatcacgctttacggaaaaaccagatatgatgactgctgagaaacttatttcggagggtgctttctggaacggaggcgtattcgctttccggttggggtatatgatagacattgtagcccgatacatccaaaccgacatttttgcggaaatccgttctcgctatgtggaatttccgaaaatcagttttgactacgaagtcgctgaaaaagcgcagtcggtagccgtcgtaccttttgccggagagtggaaagaccttggtacatggaatacgttgactgatgaactatcggaacacaccatgggcaatgttatcatggatgaagaatccgagaatacccacgtcatcaacgaacttggactgccaatcatgtgtattggcacacggaatctggtcattgcggcatcgaatgacggaatcctgatttcggacaagaataaaagcgagaacatcaagacctacgccgaccttctgcaatatcggccgatgttcgaggaacgtcgttggggtgaatacaaagtagtcaataccgccgagttttccgacggttacaaatcccttaccaagcaactgaaaatcaaatccggtaagggtatcagctatcagttacaccgccatcgcaatgaagtctggacgtttatcgacggcgaaggagaattggtactcgatgatatcaggtcggttgttagcagaggcgatacggttacgatcaagaaaggtgttaaacatacagtcagggctatctccgacttgacattcatcgaggtacagtcaggagagctacttgtggaatcagatgtagaacgttttgaatggatatggaacgacagatagacaaatccaaacacctgatattcgaacacgatacttatcaggcgaatatcgaatccttaagacaggatctgaaggacaaaaaaaagattgtcctgtttgtaggtgccggaatcaatttagggagcgacagcagcattgatatcagttggaacgggctgctaaacatgatgctcaaagacgctttgtccatattgtctgccgagaaaagatatacgactaaagagaaggaacgtttggaaaacctgttatgttcctcacgaagaatcggtctaagaactgaagaagagcaatccctttgggaaacattacacactaccgttgaaggagagttcacgtccttggtgcgggcttccatcatcaaatccattttgggtaaaaattacatccatacgatccgccatcaattgtaccggtattgtgacaaggacaagatgactgaaatctttttggaatgaaatcgtcactgcatataaataacggttctccaaagataattattatcagtgccctgacttttgtctgtcaaaataatggaggaataataataaacatcttcgactttcttttgaatgaagccagcttgaatatatgaggtatggttacaattcaaataacctttataccccaaccgagaaacgtaaaattcttcttgattggggtaattttttaatataattactggtcgtgcaatcgctggtagaagcaatatgcaggcattccgaatatatcttttttcggtaaccacaaattgattatgcaatttccctcacttaatccctcaacctccctttcttgaattttttccaatcctcttcccaaacattttttatttttccttcgagattttttctttaatcaaaaaatattcttacctttgtttaaagaatagttgtttcacgagtatgagactgtaaaatactgaaattagcacaatctccaaatcgttaccttagacttttcagaacttccataagcgtttgtctttcaaattaatccatcaaattgataagaatttaaagtaaaagatggttgttttacaacccgtttctgtcgactgtccaatggttatagtgtggcgacgactttgtctgggggtaaggagtttttcattctctttgatagggattttaaagaaataaagcgtttcggtaatcatccggtgcggggaatgactactgaagcaaatgattttatgcagttgcagggggagatggtttcatacaaaaacagcttttattttgcatctagattttttggttatctttgtcggtatgatatatcggatgaggaagatgttactttgaagtgggaaaaaatgcttgttgagcctgtttgcaatgtctatgaagcaaatcttgcaagaaagaagaataacttggatggattttatggattgacagccaatgataaatatgtttttgtgacttatagtggtgagttatgctataaagcctttgaaaactattcagcctgtacacctaaaactttgctgggtttttccatcgatggtgaactggtaggcaagtacgcattggaacaccaaagcatgagtgtgcttctttctcaatatacccctcagttgtacttgttaaattgcgaatcggaatgtaatgttgaaatatttgagatggatgatatcctgaaagcaaaattatgaaaatcctgctttatgtgttgttggcttttggggtattttgtttcttctcgtgtaaaaggacagaaaaggagcagttgacttttttgatgaaagaatggactcgaaaagaaattctctttcatgatagagctgtctttaccatacaaggcaaagacacattagataagtttccttatgcttcaacatattataaaattgtaacttatgtagactcattaggatgccttagttgcaaattgcaattattggaacggataaattttatagcggaggtagactctgtcacatctaggaatgtatccttttattttttcttccaccctagaaataggaaggaactaataatgatattacagtcagaagattttatttatcctgtatgtatagatctgaaagatacctttaataaactgaataagtttccactgaatgataaatttaggacattcttgcttgacaatactaataaagtgatattagtaggaaatcctatgcatcatcctcggataaaagagatgtatatgggacagttgcgtgattgtaataataagccggaggtggagggtgatgaatgaaccagagggtaaaagaaaagaataaatggatagaccgtttaataaactttgtattttatggttgtgtacttgctctgatatggttgctgttacaaatcacgaccttttcttcgttcaggattcctactgcatccatgcatcctactctgataaaaggtgactatgtaatagtgaataaatggatagcaggcggcaggatatttaatgtttttaatgcggtaaaaaacaagcatatatcaataaaacgtattccgggaatacgacggataagaaaaaatgatattctcatttttaattcaccagtcgggcaatataagaatcgaatacattttgatgtcatgcaatattatgctaaacgatgtgtggggcttccgggtgacactgtggcaattatcctgcctacattatctgccttagtcgaggatagccttacgttttcttttgatcataattactatgacctgttaggatggactgctgaaaaattcggtcctctttatataccttgcaaaggtgatcaaatcccgataaatagtttgactgctacccaatatggaagtgttatggaatgggagactaaacagaaaatagattataaagatagcgcatattttataggaaatcatcgtttcacaaattatcagtttaagcatgattattattttatgctgggagacaatatacaccattcattggattcacgacattggggattggtgcctgatgatttcattgtgggtgtagtacaatggatttggttttcaaaagatgaagagcaaaattcaattcgttggaatcgaatcggtagagtagattgaaataagagatgcgaaaggttatagttctatgcttgttcggataaaaacgtataaatgatgcgttgtgatatatgttgtatgaaaagtttttgttaatattgtcatcattatgagtttgtttttgttgtatgatgaaataataactgaagaattatgaagaaagtattgtttttattcgcctttttgcttctgggtataggagctatggcacaaaaggtaatttatgatgaaaccaaccagaccggagtgcgtacagtggtatgcgagggtatgaatctgggtgtttccaataatatggacgtatatgtggcactcgctggatttcagtataaaagtaccatacgttattcgctggctgttactatcgggtcggggcatgaggtggaaattcctaatgacagtaagtgtgtcctgacgttggataatggaaaggcattagagctgcctacggtagcaggcggcgcttctgtattgcagcatgtagatgtggagatgagtgatgtgtatcaaagtttccgccgttttgcctattataatataaaggctaaagaattgaagaaaatcggcaaaaacggtatcgtacaaatggatatacagttatctcccggaaactattccattgcattcaaccaggatgtcttgggaagtatgctgaccggttctatgtcattaataaataatatgtttgggaaataacttcttttttcatattgtatggtgcagccttttcttctcagaaggagaggctgtcttgtttttgaaagtcaaagggttaaacaaaacgttgtttcatgtgttttcctaatgttttttaatgtgataaacttatgaggaaaatacgtagatggggagtatggctccttttaatcattcctttggcactgaatgcccagcagcgggccgaaaaattattgaatgtacccttgccggaacattggcaagaagaggatgcgatgtttcaacaactgcttccggtggatgaccattggtggactgtatttcaggatgccacactggattcattgattcatgtggctgtcaggcagaatccgtctgtccttacagccttgaatcgtatagatatggcgaaagcgaatctgaggatagccagaggaggctattatccggctttgtcattggatgccgggtggaaccgccaacagactagtggcaataccggtacgggacagcctcaatccagagtggggtattatgatgcaacggttaatatgagctggcaggtggatgtgttcggttccatccgccaacgggtgaaagcgcagaaagaaaattttgcggcaagtcgtgaagagtacaatgcgacgatggtaagtctttgtgcagaagtggcgtcagcctattttaatttgcgtgaggcccaacaggaacttagtgtgttacagcgcaatgctttatctcaaaaggcggtggtagatataactgaagtgcgttataataccggactggcttccaaactggatgtggctcaggctaaatcggtttattatagtacattggcttctattcctgctacagaatccggtattattcaatatatgaatgcgttggctgtattgctcgggctttatcctcaggatgtgacggctgcactggaaacgggaaaaccgttacccgattatatagagccggtaggggtcggtcttcccggacaattacttttacgacgtcccgatgtacgggttgccgaacgtcaagtcaatgcacaagcagccttgttgggagcttccaagaccgattggcttccctcattttttctgaacggttccttcggctatgcttcacatgatatgaaagattttactagacgtagcagtatgacatggagtatcgctccctctatgagctggacgatttttaatggtggccagcgtgcgaataatgtacgcttgcagcgtgcacaactggatgaaacaatcaatcagttcaatactacggttcttacagcggtgcaggaggtggataatgccatgagtagttataagaattccatcaaacagattgtagcatgtcgtgagatgttgaatcaggggaaagaggcatttaaactttcattggacttatacaaacaggggctgagccctttccaaaatgtattggatgcacagcgttcgttactgtcatacgagaattcattggtgcaggcacagggatattcattgctttgtctgatccagatgtatcaggcattgggaggaggctggtaggctgcgacggaaaagctgttgaactatagaaataataaaaacctaacccaagatatgaaaaaaataatgatagctttcgcatggacggtatgtgtgttgaccgcctgcgataaaaataaaccttctcagacagaaatgcaggcattgcctgtagatgttgcgaaacctttggtggaaaatgtgacgctgaccaaagattatcccggttatctggaagcggaatctactgtagatttggtgggacgagtaaatggaactttacaatccaagaattttgcacctggttcccgggtacgtcagggacaggtattgttcgttatagaaccgacactttatgaaaattcagtgaaacaagcggaagctgaattaaaaacggctaaagccaatcttgaatatgctgtcagtagttatcaacgtatgaaagaagcgataaaaagtgatgcggtgagccgtatacaatatttacaggcggaaagtcatgtggcggcttgtgaggctgccgtaagtaatgctgaagcagctttgaaaactgcgcgtaccaacttgagttattgctatgtcaaggctccttgtgacggagtggttgatgtttcggcttattctgtcggggcgtatattggtggtgctttgcaaccggttaaattggctactgtttataaggataaccgtatgtattcctattttaatattgcagataaccaatatctgacatacgagctggcccaggaggctgccagcaagattcctgcggaaactcattttgtaaccttgcgtttgggaactgacggggcacagtcatggaaagcgaaactggattatctttctcccaatgtgacattaactacaggtactctccgtttgcgtgcggaattggataaccctgacgggatgcttcgtcccggattatttgtcagtgtcaccttaccatacggtgaagcgcggaatgcagtgttggttaatgatgcttctatcggaacagaccagttgggtaaatatttgtatgtagtgaatgacagtgatatagtgaattatcggcatattgaagtcgggcagttggcggatcataatatgcgtgttgtaaaaagtggcttgtcaccttccgaacgttatgtcaccaaggcattgttgaaagtgcgtcaaggcatgaaaattaaaccgatagaacaaaccaataaacttcaatagccttatgttttcaaaatttttcatagaacggcctatatttgccacggtgctggctttgttattcgtggtggccggacttgtaaccctgaatatattgcccgtggcgcaatatcccgatattacgcctcctaccgtgcaagtcagtgcggtatatccgggtgccaatgctgaaactgtagctcaaactgtcggtatccccattgaacagcaggtaaacggtgtggacggaatgttgtatatgagttccaattcctctgcatcgggcgcttattcgctgacagtgactttcgaagtgggaacggatatcgatatggcaactgtgatggtacaaaaccgtgtcagtgtagcattgaattctttacccgaagctgtgaaggtacagggagtgacggtgcagaagcagtcatccaatattgtgatgatgcttacactgagtggtgacagtatttatgatggcctttatctgaccaattatgccaatttgaatctggtagaccagttgacacgtgtaccaggggtaggagcggtggatgtcatgggagccggtgattattccatgcgcgtatggctgaatcctgaaaccatgcgtatccgcaatattaccccgcagcaggtttatgctgccattcaaagtcagaatatggaagtgtctgccggttatgtgggacaacccatcggcagttcggccgataatgattttcaatatacgctgaatgtaaaaggacgtctttctactcccgaagagttcggcgacatcatattgagagtggaagaccagggaaaagtgctccgtctgaaagatgttgcaaaaattgagttgggcagtgccgggtatggagttgtttcccgcttgaaagggcaacctacggctgctattgctgtttaccagttgccgggaagtaattcgctggatgtttctaaacacgtccgtgcccgtatggcggaactggctgaaacatttccggccggggtgaaatacaatgtgacgttggatactaccgatgtggtacacgactccattgatgaagtgatgaagacctttgtggaagcgattattctggtggtgctggttatcttttttttcctgcaaagctggcgggcggttcttatcccctgtcttactatccctgtgtcccttatcggaacattggcggtaatggctgctttaggcttttccatcaatacattgacactgttcggcttgatattggctatagctattgtagtggatgatgccatagtggtgactgaaaatgccacccgtattctggatgaagggaagctggacgcccgtgccgctaccgagcaggctatgggggagattaccggacctattgtcggagtggtgctggtactgcttgccgtatttattcctactacgctgattagcggtatttccgggcagctttataaacagtttgctttgaccatcgcggcttctacagtgataagtggtttcaactcattgaccttgactccggcagtctgcgctctgttgctccgtcccaccccgacgcataaagcgcgtttgttcctctggtttgacaagatgaatgactggatgcagcgggtttatgacgcttcggtaaaatggttgttggcacggccggtcattgctatcggttcttatatcgtaatctcagtcattgctattctgatgtttgtaaaatggcccagcacctttattcctgaagaagatgacggatattttatgattgccattcagcttccggcagcttcttctttagagcgtacacagatggtgggtaagcagattgatgctattttgtcagagtatcccgaagtgaagacttatttgggcgtaaacggattcagtatcatgggaggtggtcagttgcctaatgcggctacctattttgtggtgctgaagaattggaaagagcgtgcgggtaaagagcataccgctcaagcggtggtcaatcgttttaacggacaggcatatgccatgatacaggaagctcaagtctttggtattattcctcctgctattccaggtatgggcaatacgggtggtttacaactcgaactggaggatcgtaagtctttgggtccggaagaactgcaaaaggcggttgaggctttattggctaattatcataatgaaccggctgtcgcttccatgagcagtatgtatcaagcggatgtacctcaatattttttgaatatagaccgggataaagttcagttgatgggtttgcagttgaatcaggtcttttctacattagggtattacatggggcaggcttatgtaaatgattttgtggaattcggccgtatctaccaagtgaaattggaggctggcgaacaagcccaaaaagtgattgatgatgtgttaaaactgagtgtggtcaattcgaagggagagatggtgcctttcagcagttttacgcagatagaacaaaaactggggatggaccagataaaccggtataatatgtattcggctgcttccatcacttgtacgccggctgcgggcagtagttccggacaggcgatagaggctatggggagtttgattaaaaatcagctaggtggtgagtttggatatgaatggacctctgttgcctatcaggaaactcaggcaggtaatactactacaattattttaatcatggccttgttggtagcctatttggtactggcggcacagtatgaaagctggacaagtccagtggctgccgtgatggggcttccggttgctattttgggagcgatgttgggctgctgggtgatgggggttccggtgagtatctatacccagatcggtattattctgctgatagccttgtctgcgaagaatggtatcttgattgtggagttcgcccgtgattaccgtaaggccggcaatcctatccgtgaggcggcatacgaggcagggcatgtgcgcttgcgtcctatcctgatgacttcatttaccttcgtgctgggtgtgatgccgttgttgtttgccacaggagccggtgcaggcagccgtgtggcactgggtgcggcagtggtgttcggtatggctgtgaatacaatttttgctaccatttatattcctaactggtatgaagtgatgcagcatattcaggaaaaatggctgactaagaaaaaataattgtttggtttcaccacagattggtcagatttatacggacaactcgatttaaaaactgtatggatttgcgttatctgtggtgaatttgtgtatctttgcgacaaacacatggaaatatggatacaataaacaacgatcttactaacttattgcaacagatgggtgtgcataaggaaagcctgggtataacccagcgtattgtcattatagcagggattctgatcattgcttttgtggcagattatttttgtagaaaaatagtagttcctactataaagaaactgacggcaaggactcaggctacttgggatgattatttattcaatgatgctgtattagataatatgtgtcatcttattccacctattatattgtatgtattgcttccttttgcttttccgcatgaacctgtgactttgacattcattctgaagctatgttgggtgtatatcacggctgtagccatgaagttgatttgttcttttctgacttctctctataccatttcaagcgaacatgagaaactaaagaatcatcctctgaaaggggtatatcagatgataaaactgattgtgatttgtgtaggggtgatcattatagtcagtaccttgattgataaagatcctgtgaatattcttaccggattgggtgcttctgcagctatcttgatgttggttttcaaagatacgattatggggctggtagccggagtccagctttctgccaatgatatgctccgtccgggagattggattaccatgccgaaatacggagcggacggtacagtaatagaagtgactcttaccactgtaaaggtacgcaattgggataatactataactacagtcccaccttatgcattggtcagtgattcgtttcagaattggcgtggcatgagggaaagtggtggacgcagagtgaaacgttctattaatatagatatgaatacggtccgtttctgtacaccggaacaaatgaaaaaatttgaaaaacaagtctggatgtcaggctttgaaaagacaggaaaggaggaggtgaatctttatgtatttcgtcactatatggaatattatttgcgtcataatcctcgggtgaatacagaattgattttgatggtgcgtcaattacaacctacgccgcaaggattacccatagaactttatttcttctcagccaataaagactggattccatacgaacgtttgcaagcagaggtttttgaccatttgttggctgttcttcccgaatttggattaagggtattccaaattccttcaggattggatgtgttgtctctttcttctcattaattatttataatctcactagcggagaggtacaggaatcatcacatattaacatggattacatcaaatttattgattgtcaaaatgaataatccgtgttaatatgtgagaatgtacactattatacatgaagttccagtataaaccgagttccttttttataatcagtgtccaaagtcagtgtaccatttaatttataagcgataaggctgcaagtaggcaaccctagtccgtttccttgcgttaaatcgcgtatttctgcaaatggcttgaacagtttttcacgtgcttcaaccggaattcccgttcccgtatcggttagtatgaattgatgtgtatgggcgcttcgttttttgaattccagtgaaatcttaccacttttcgtatattctgccgcattgttcaataaatggtttaatatacgttccaattcttctgcatttgtcttaatatttacacgtggaacatttaccactgcttctactccggatttgaagtttattttcgctttttccataatactttcacacaatgtatttatgttcagttcctttagcggataatgttcttcacgtgtttcttccaatgaaatatacgtttggatagctgtcattaattctttcagtgccttgatgttttcatgtaatattggggtggatattgtttcctttgttgcttcatctattgtattcagacttggttcaatttgggcgctgatattaccgataaatttagacttctgctcattgttttcattcgctatctgcaggctatgttttaatttctttacttggcggatatgtttaaataacagggtagctaagaataataatccggcagccaatatggcggataacacacatagtgcaatgataataattagatttgtggtaatcttgtcttctttttcctgcaaagtcttttggctggtttcatatttttgttgcagtgtgtttagttcattggctgtttttactgcttttatggaatcttgccatgaagtataaagttttctcattgcaatagccaatggggcattattattctgttcggcatatcccaacatgtctttatagcattggtctattcctttttcgtctttaccggcagagcgcttttggaataagatgttgtaacattccaagcttttgtctgtcataccgaaagtttgataataattggcttccgtcattagaagctcttcttgtaaagagtctgattttaattggtctgtataggaatgaagttgtttcaatagtatcttgcattgttctgtattttttagattcgtatacatacgcaggcgttctttacccaccatgaaacgtaatttgtattcgggtgattttttttcttgctcattataataaatcaatgcatccatttgtcggcaagtggcaaaggcttctttatattgcctgttttgagtaaagagcgtacttatccgtattccctcttctaccgctttatttatttgcttttgttcggcatactgagtgaattttgcccactttgtatttaactcttgaatattgacatctgccggtttggctgtagtttgtccttgccctgcagcacaacaaaaggcaagtgctaatgttagaagaatttttttcattattgaaacaggttttctgcaaatataacctttttttaagcaaaaagtttagggaagtgcaactttttttcagcttctagcgtctaaacagtaaaacaataacttttaagcaggacaggccatcttgtaaaaagaataaaatcataatatttaaaatgagaaaaatagtaatgatagctatactggtagtcagtatggtacaaggagtttttgcccaacaaataattataaagggcactgtgaaagacgcgacaagcaaaaaggcagcagaatatgttaatgtagttttacaaacagcagattcggtttttgttggagggactactacgaatggtaaaggcgatttcttgctgaataaggtttatgcaggcaattatttattggcactatcctgtgtggggtatcgtacgcaattcattgtattagacggaattaaacagaatataaatttaggggaaattttgttggaagatgatgctgtggctatggaaggtgtaacagttagtgcttccggacagatcagtcattcggatcgtaagttgatttttccttctgaacggcaaatgaaggtttcgacaaatggagtcaatctgttgcaacagatgatgcttccccgtattcagataaaccccatgaataatgagataggagtgttagggggaggagaacttcagcttcgtattaatggagcgaaagcagaagttgaagagattaaggcattacagccatcagacattattcgaatagagtatcatgacaatccaggtttgcgttatggtaatgctgaggtagtgcttgattatattgtccgccgtccggaaacggggggaaactttggagtggatttgtctcaggggatgaatgccatgtggggagaatataatgtttttggaaaagtgaaccataagaagtcggagtttggcgtttcgtattacatgggacctcgcgatttctatggtatgtaccgggataatgaagaggaattccatttggcggacggaacgacattacatcgtatagaagaaggtgaaccggggcacggatctatgtttatgaataatttaagtatgaattataatttgcagcagaccgaaaattcattgttcagtgctacttttcgtttgagaagtaatagccagccgcattggaattatcaaggagtattgactaatattgccgattctgatgataaggtggatatgatagaccgtactaaagaaagttggtctcgtccttcgttggatctttattatcaacagggattgaaaaataagcaacttttggtattcaatgtggtcggtacttataataaggaaaaatcacgccgtttgtatcaagaaagtttgcaggatgagttgttgactgatattaataataatgtattgggagataaatattctctgattggggaggctgtttatgagaagcaattttctaaaggaaattccttgagtttcggtttgcgccatactcagtcttttgccaataatgaataccgtaacggtcattattatgaaacggatatgaatcaaggggatacatatgtttatggtgaatatagaggaaaggtgaaaaaattggactacagattgggggtaggcgttactcgttcttattataaacaaagtggtgatgattcgtatgagaattatagttttaatccccgtttggtactgcattatgcattaccgggaaattcatttgttcgttggaaatccgatatcagtaatgcttcgccgtcattgggggatttaagtgctgtagaacagattgtggattcgttgcaaatcagacgaggcaatccgaacttgaaagcctatttgcgttatcacacagagttgacatacgaatggcagaaaggtatattttattctaatctttggggagcgtatgattatcagccgaatgccattatggacgagaagtatcaggacggtgacaagattgtacagacatgggacaatcaaaaggattggcagaaattatcggggcgtctgactttgcgtgtcggtcctattaaggatatgctacagttctcgtttaccggtggagtaaaccattatatgagtcatggtaatacatattctcatacttatacaaactggtattgtaatgctgaagcatcctttaattacaagcagttctctctttactggcagatgaatactaactggaataatttctggggggaaaccttgtcggggggagagaatattcaggtattggtgatgtattacacgcataagaatttgcgtgtggggttgggcgctttcaatccgtttacggataattataagcaacagactgagaactggaataaatatgcttcttataaaaaaacgaattatgtgaaggagagctcgcaaatgtttttggcaagtgtttcttataatttctcgtttggccgtaagtttaagacaggtcaacggagggtgaataatagtgataacgattccggagtgatgagtaccggaaaataaacaagataatcatttgaatgaacttaagttcatggggcaagtaagttaagtaacttgactcacgaacataagttgcttggcttacgaagttaagttcataaatttaccggaataatagatatattacccttaacaaaatcatatatgaaaatgaaaaaaaacttgattgattatgaactcctgtgggagaaaattacggattacgcaaaggccaccggtagaacgactgctcgtcctgtacttctattatattatgtattgcgaagccccgaaactccctcttcggataagatgttgattgtggcggcactttcgtatctggtattgccgatcgatttgatttcggctaagcggttaccaattatcggctggattgatgaagcggtatctttggtttatgcttataaaaaggtgtgccgctatgtgactcctgagattgaatcagaagtggataatatattggaacgctggttcccggaaggaaagtatgagttgatagaagaataaatattgtacttgtctttggggagtaaggatgggtaaatggagtattttaggaatgggcttcgtcgaatttcggcgtggcccttgctgattgtagacaaaggtaaattgtaactccccccaaggaacttcattttgtctgagaatatgtgaggtatgtaaaagcgttacaatatgttttgagtcttattaattccctataattcaattattaacatgacctaagttctcttagaactttatattaaatattgctgcaaagatatgaaaatatattaaatatcaaagaaattgcagataaaatgttggataataaataattttattctattaagccttactttttgcttgccaaatccagcaaaacaactctttttgagcgtttttatctaagttctaagagaacttagcatttatgaacgttaaattaaaaagtttttttatgaaaaagagagttttgtttacgttggcttgtctattcctatggacaggtatggcaatggctcaagtatcccgaattactggagttgtagtttcggcagaagacaatgagccgattgtcggagcttcggttcttgtgaaaggtactacccttggaactattaccgatatgaatggccggtatagtataaacaatattccggtcaatgcaaaatctttggtaatatcgtttgtcggtatgaaaacacaagaattggctataaagggtggtgagcaaagagtagtgatgcaaagtgatacggaattgattgatgaggtcgttgtagtggcttatggtacacagaaaaaatcatcttttacaggagctgcttccacagtaggggccaaatccatagagaaacgtgctatcactaatgttacagctgcattggaaggaaatgcttccggagttcaggtgactgctgccaccggacaacctggtgaatcttcttctatccgtattcgtgggtttggctcagtcaatgcatccaatgctcctttatatgtagtggacggaactatatacaatggcagcataggtgatattaatcctgcggatattgagtctatgactatattgaaagatgcggcatctacttctttgtatggttcaagtgcgggtaatggtgtgatcttgattactactaaaaaaggtaaagagtcaggtggaacaggagtaaacttgaccattaaccaaggatggtcaaacagggcttataaagattataaaaaggtggggatttatgattactatcctttacaatgggagatgttgaagaactcttatattacatctggtaaggatgctgcaacggcggcctcattggcaacatctaaaattggaagtacattgaagtataatccttttgttggtgtcgcagatgatgccattgtcggaactgatggaaaactgaattcttctgctgatgcattgaagtggggggatgatttggattgggaagatgcagctttcaagaccggctatcgtcaggaatataatttgagttataatacaaaaacagaaaaaagtgatacttatgcttctgttggctatttaaatgatgatggttatatgatcaagactgactttgaacgttattctggtcgtttgaattataatgtgtatcctactaaatggttcaagactggtttgaatttgggagtaacgcgtacggtatccaattattcaacttcagattcgggaaattcgagttcatatagtaaccttacccgttttattcgtaccatggctcctatatatcccgttcataaacatgatttggaaaccggtgcttatttggatgctaatggtaaggcaactactgatctgggtgaatatatttatgattatgaaggaactcgcttgtcgaataatggacgtgatgcgatagctgaaacagagttcaatcaacgtgaactggtgcgtgttaatcagactggacatacttatctcactttgactccggttgaagggttgaaccttacagccaattactctatcaataatattgattatcgtcgtaaagtctatgaaaatccttatgtgggcgatggcactgccggaccgggtcgtttgaaccaaatgtctacccgaacgctgactcagaccttcaatcaattgataacttatagcaagtctatcggaaatcataactttgacgttcttttgggacatgaaaactattcttataagtatgagtatttatatggcatgaagacccaggaaacagtttcgggcatgtatgaatttggtaatttcgtaaatatcagttcacttagctcctatacgaacacctataaaaaggaaggttactttggccgtatcaattatgattatgcgcataaatactacgcttcactttcttatcgccatgatggttcctcgcgttttgcaaaagagaaccgatgggggaatttctggtcgttcggagcaggctggagaattagtgaagaggcatttatgaaggatgtgaaatgggtgaataacttgaaattacgtgcttcttacggtgaaacaggtaatgataatatattggatagtgatggtgatcctgattattatccttatcagaccttatatggtttgggatataagaatggctcagaagctggagcctacttcacggtgatagccaatccctcattgaaatgggaaacacagatatctacggatattgctcttgaatttggtttgtttgaccgtttgacgggtactattgaatattttaagaaagattccaaggatttgttgtttgatgtttcccagcctgcttctgtcggagtaacatccattatacagaatatcggtaaggttactaattcaggagtggaaatagagttggattataatgcatttaaaaataaagattggagtgtatctgttggggccaatgctacttttgtgaagaataagatcaagaatctgccggctacaatgaaagaaaatggatatatcagtggctcaaaaaagtggttggaaggaaagtccatttatgaattctggcttcgtcaatggcatggggtagaccctcagaccggtgatggtttatatgtggctgatgtaagtaaatataatcaagggaatatcggaacaggggatggaaacattacgcagagccagtttgatgagtataaaaaaacagtagtgactattgatggtaaggaattgaccaattcgtatacttatgctaaatacgacttcagcggttcttctattcctgatgtgtatggtgggtttaatgtcagagttagttataagaactttgaattggctgctgtattctcttaccagttgggcggtcagattctggatactaattatgctaccatgatgagtatgactgaatttggttatgcacaaagtccggatttgttaaaagcatggaaacaggcaggggatattactgaggttccccgtatagacaatagtgcggctcataccacgaatattggtcagtcttattcaactcgttggcttaccagctcggattatcttaatttaagatctgtcactattggctatcagctcccaaaaacttggttgagcaaagtgatgcttaagagtgcccgtttgaatctgactgcggaaaacttgttcatgttgaaagcccgtcagggattgaacccgatggccaactattccggtgtgacttataatgagtatatgccgtcccgtaatatcacgttagggcttaatgtttcattctaaaaataaaagaattatgcgatcaattaaaaatataacattaggattagcgacagtgggagtaatgtctctatccggttgtgccggtgattatctggataccattccgtctacctctgtttcagaaacgacaataaacacctcgttggacaatctttatatagcattgaacggaattcataaagagatggtttctcaggaaagcggatatcagtgtctgggcggtgaacccggttttatgatgtcacgtgatgcagaggctgatgatatgaattggcagacaaatacatggatgaaggcggcctatttaggatggcaatgcaatatgaatgaaacgaatggttataattataagttctggcagatttattatcaatggattctgaatgccaataaaattttggcgggtttggaggaagttgaaataactagccaggaattgtttgaccagataaagggagaagccttatgtatccgtgcttgggctcattttaatttggtccagctttatgcaaaacgttatgaagccggcaaggataatacacaggatggaattccttatcgtgaaaaagctgtggccgaagagcaggcacgtaattccgtagaagatgtttatgctaaaatcaataatgatttggatgaggcttgtatacttttgagtggaataaaagtaaatgatgtcaatcattatagcgagatggtggcatggggattgaaggcacgtgtagcactggccatgcaagattataataatgcggcggtttatgcagggaagtctgtttctttagctgaagctggtggtcaccggttgatgactggcagtcagttgaattgtgggtttgccaatatcacgacggacactaaagaagcgatgtatgctgcaatgactcccgatgataagactgtctatttttattcttattatgcatatatgtcatggaactttaactccagtgccattcgtcagggagtgaagtgcataaatgtggatgcttatgaaacgatgtctgaaacagacttacggcgtgcgtggtgggatccgacaggggaagcatctgttccatcatcaagttatgcaaagaatgcttatcaaaaccgtaagtttactgcccgttctacagccgatgctgtaggtgatgtcgcatttatgcgtttggcagaaatgtatctcacccaggccgaagcattggctcgtgcaggaaaagatagtgaggcgcaggctgtgtttactaaattccagataacccgcgatccctcttatgtttcaaaaggaaatatcggtgatgctttggcagaggaaattatgaatagtcgccgggtggaattgtggggtgaaggttttcgtttttatgatttgaaacgtttgcatatgtctattaagcgtggatcaaattttgatatagctttctgtacttttcttgaaaaggataaagatgcacaaggttgggtgtgggagatacctaaaattgaaactgactttaattcactttgtacgaagaactattgataattccctctaacacataaattttctcttaaaggaggtgggcagaatttttcttgaaagttttgtagggatattcagtaaatgtctctaaaaaataagatggcatatgaagatgatagggggcttttgactttattataacttggagagaaacacgcacgaggccgaatgcttacgattgaggaatatcagaataaaaaatctatttattcaaatgaaggcaaagtcacagagaaatgaggattcggagtatgctgtgttctgataatctctttcatttgtttcacaatatccggatgtccggcagcgatatcatggtcttcatgaatatctgtagcaagattgtaaaggaaaggagtcccttttttcactaccatcttccagtctcccatacgtacaccaatctgatcggtttcatcaaattcccaatacaagaaatcatgtttcttctgtccttcctgtcctaacaaagtcggagcaaaagaaataccatcaaaataatccatgtcttttttcttgttagtgtacttcttcacataattcttcacacctgccaagtcacaaaatgtaggcatcaagtcatagaaagctaactgatgatcattaaccgttccttcgggtactttacccggccaacgcacaatgaacggaatacgaatccccccttcataacattgacgtttcaatccacgaagtttgccatcacgaccaaagaaggtagggtcagcccccccttcttcatgggggccgttatcactggtaaaaatcacaatggtattttcgtccagtcctttctcctttaatttgttcaaaacttctcctacataataatccaagcgagtaatcatgccggcaaactgcgcatgggtgtgtaccgacggattatatcttgatccttcctgtccaccccaagttttatcttcaaaaaacttcttttgataacctgtcagaatagaatcttcgggctgcgccagctctgcatgaggaagagtataagtaaaaataccaaagaaaggttgcttgccatcctgtttatccaaccatttcattgcttcttcatggatcatatccgcagaatattgcggacgtttgaaatagtccttaccaaacataggatagttgatattctcatccatcactacacgaaccactgccgtatcaccagccgatttactataccggttcaggaaattcggataatataaatgagcctgaaactgacaaatataaccataatattcatcaataccccgtttgtccggcgtagacacagatccctcatagccccctgcccatttaccaaacataccggtagtataaccgttatctttcattatttcaggtataatcacatgaccgggatcgtatggatgttgccccaccacggcatattccttattatttccatacatcacaacaggggcatcgcgccagtactctttgttcccacgtacttcacaatgtccggaatgttgtccggtcataaatgacgcacgtgatggagcactcaccggactaccggcatacgcttgtgtaaaacgcataccttctttagccatattatcaatattcggtgtactgatgtaggactgaccataacaccctaaatcaccataacccatatcatcacacataatataaatgatattcggtttaggagttttctgagcataagcgcctaatagaggaaatgctaatccactggttaaaagaaagaggtttcgatttttcatatattctgttttttactgaatttaataattactactcctgctataaacatcggcaatttagagaaaatatcctaggctgcaaagctatagaagaaaaaaatatcattcacctactctcgataataaggattcaatttcacaggaataggagcatgagtttcttgaatccacttcatcagtttctgataaagttctcctcgctttacaggatttgaacctgatagatcttgtgattctcccagatcattcttcaaattaaacagttccatagacttatcttcataatgatatatcaatttccaatcacctgaacgaatactggaataaggttttgcacggaaatctcttcccccgtttaaataagactccaaataagccggaaaatgccagaaaagatcacgttccgtctcattattatttataagcgtaaaaatatcttttccatctaagttagcaggaatcttaccctgtgccaaagtaacaaaagttggataaaaatcaactcctgttattggaacagatgaacggatgcctccttctattttaccagtccaccttataatcaacggcacacggctcccaccttcataaggcattccctttcctccatttaacggataattgtctgtcactggttccgaacctccattatctgaataaaaaatgactattgtacgatctgctattcctaatgtcttaataacttggcatatcctatcaacactatcatctagtttttcaatcattgcagcatatataggattcttatgatatttaccgggagttttattacgatatttatttatcaatgaatcaggtgcttgcaaaaccgtatgtacggcatgatgggacaaatgtaagaaaaaaggaccttcactatgagattttataaaagaaacagcttcttcagtcaaccgatcagtaagatattcacccaatataccttcttctaatcccacatgacatttacttttatcaggcagacaatagggataaaaataagaatagggagctcctgctctattaccgcccacattccatataaatccctgtgacaagggtcctgtaccgtcctcatcatcccccaaatgccacttcccgatatgaccacactgataaccctgttcttgcaaagcctcggccatagtcacaaagtcggcacagacatcttctacattgggaatagctatatatttacgtttggtacgatcaccacggtcgggaggactaactgtatatactccatggcgtggtgtgtacattcctgtcatcatacaagcacggctaggtgctgaattggcggctgcagcgtaagcattgtcaaacaatattccttctgtagcaagacggtctatattaggagtttcataataatcactgcccattacacccaaatccgtccaacctaaatcatcagccaaaataaacacgatattaggtttttcttttgtaactatatcgatagaaaagctctgttgtattcctacggtacacaacactacagtagtcaatcctattttctgaaatctcattttatttcgatttttctaagtttaaaaaccaaacaagaccgtctccatacgttattccgcatttgagacagcctcattcgtatcacactataaattaccaaccaggattctgttccagttctgggttcaataatatttcggtagtcggtacttgatacaaataatatttatctaaccaacctttaccttcttttagaggatcattgaaaagatacaaattaccttccgtcaatgaaccgtcagttccatcagaataaccagtttcaggattatataaagtcatattatttttcattgcctcttctttactcatccaaagaccagttgcaggtttattgaggaaccacggagccatacgccaacgacggatatcataaataccaaatccctcacccatcaattctataatacgttcgcgacgaatttcccataagacaggatcaaccaaaataccactttcattacctttaggatagtattttccacggttaggatcaaaactatcattaatgtcagcaaccaccattttgactacaccggcacgatcacgtaacttattgattgttttgtctgcaaccccttggtcaaatactcccaattcaaatttggcttcagcttcattcaacaggacttcttcaattttaaaaataggtttgtcagctgtattcaaattaccattattaaagctggtttcccagttatcccaattcttccatacatagtagcctgaacggcaagtcacaaatgctccagtacctaatcttggtatttcaggtacaagtgatgcactccagttctgcccaggcaaacgtttcataccaacacccgggttactgcaactttcatttgctcccataatatcaatatattcacggtctgccggattgtctgtatacgaccaggtaggatagtcgccttttccagattttactttataaggaggtataaccgtgtgatacaaacgcgggtcacggtcacgaaataccgcatacatgtccttatttccatggtagcccgatccgtcagccaaaatcggcttgccattcttcatcaaataaagatctaccgtattctggttcatctccacatagtgtgaagaagtatgttcaatataactcatgcccataggatttatatccttcacataagatttatagagaatgatacctggaacttgtcccaaatcctctgttgtccacatttcaccatatccggcaccgggttgaccgtctgttcctgtgtaaagagtaggataagcggccattaataactcggatgcgcgtacacactcttgcagatatttttcagcatcacccaattcatgatatttcctccatgtaccttcacgtaatccgaaacgcgaaataacggcacgtacacaatcttggttaatcgtattgtccccatcctgtgatgtgaaatttccaatattctgttccgcccattgcagacgttccaataccttgtcggctacggtttttctatccacacgaggtccataagcttcgggagaatcttcctgcaatacctggtccacccaaggcacatcgccaaaacgatctatcaattccatataccaaaaagaatgaaaaaaatatcctactgcacgccaatggtctttctgagcctctgtcatactagaattatcaatgtgtgaaagcatgatattaacacggcggataaatgatttaaaatcccagccattaccggatgctacactggcaactgtctgataagcaaattcattgtagccactttcatatttttgctgaaagtatcctgctgccatatcgcccttatactgtccgtcttgtccgaatccttgtaaggaagtgcgaatagtattatttgtaaacatctcataacaaggccacataaaagccttgaagttatcgtaggaattgaatgcattattctccgtcaagtctgtaacaggagtcttttccaagaaactatcattacaactagagaggctgattcctgcgagaattgctaaacttataaataatcttttcatatactcgtactaatttaaggtttataatgtaagattaagcccaaaggatactgtgcggaatgcgggataatcccatttcagcgtttccgggtcgataccctttggcaatgatgagagcgttgccagattttctacactgacaaaagcacgtaactgcgacaaagatattttggtaatccatgctttggggaatgtatatgacaaagtaacattcttgatacgcagataagaagcatcggacaagtacttgtctgactggcggtaattagagccttggttaccatagttgccataaatacgtgggaactcagcattaggattaactgctgtgtaatcaccattggcagcatctaccggttgccagtaatcacccaaacctttatataaaggaataaacttaaagtcagaatataatgggaaagtcaatgtattggcaatccatttatcgcgtttaccggttccttgcaaaaaggcactcaaatcaaaacctttatagtttaatcctagattaataccataaagataacgaggagtttcattaccaatcactttacggtcgcccggattattcaacgtattgttgccgctggaaatcatatttgtccctctttcatcatccattaagttcttgaacttcacatcacccggacgaggattatagccatctatgcttggaacgccatcctttaatttccatgaagaagtatcgacaaaatcgtctacggtataataaccatctgtttcatatccccagatttcgcctaattccttacctttataaaactcccaaaatgtatatgttccacccgtcagcgcattcgtcttttggctgcttaatatgtaggatgagttactgtcatacttcacaatctttgacttgctgtcggacaggttgaaaccgactcggtagctcacctttccaatctggtcgcgccaattgaaactcagttcccagccacgtgtacgcatatctgccgtattctgataaggagcatccgcacctactacagcaggcaattgcacacccggagcaagcatgccgttcgtattacgctgataccagtcaaaagtacctgtaaagcgattactgaacatagagaaatcaataccgatgtctaatgtccctaccttttcccaagtaaagttacgacttaccaatgaaggaatagaagtaatagcggttacataattaccattggatatccaaccattgtatttattattcaccgccatagttggaataaacgaataagcaggcacgttctggttaccaatcataccataagaagcacgtagcttcaaagaacctaaccaattctgagtactttccatgaatttttcctgtgcaatgttccaaccggccgaaacagaggggaagaaaccgtaacgtgattctttaggaaacttagaagaaccgtcataacgtccgtttacttccagcaaatatttatcctgatagttgtaattcacacggaagaatccgccgcgaacagaaaactcattatacttgtccgtagctttcaatgtagatgtacccgaacccaatgaaggcacctcaataacagcttgtccataggataaagcctccattgtttcctgataactggattcttgattgaaacctgccattatcttaaactgatgattacccaatgagaaatcataagtaccatacaagttgattgagttatagtcggtatatcttttctttttttgtagatagtcattggtcggagtcgtgtctttaccaccttgcacagtagtatataccacacttcccgtataccagctataatcatatatattcttgtcgaaagtatattcaaatgctatttcaaatccctttaatggcttcaatatagacttcaggaaaatacgaggattgtcatacaatgttttttctggattggaccaacgtatctgattggacggagtaaagaaaggtaatccatcgcctgcagcagaaataccttccggcatattgccttccggatagaaagaagcaagacgagtactgtaaacagcgcccaaagcagactttggctccattcttttactatgtgcatagctaaaagtggcttcctgagtaaaccattttgtaacattggcagatataaatccactgacattcattcgtctgtatttatccttgtcagtaatcagcacaccgtcattatcaataaatccggcagaaagacgataacggagcttatcagtaccacctgtcattgatatattatgtgtatgctggaaactagtctcaagcatgttcttcaccaagtccttttcattcatataataaacagccccatccgtatctttaaagataccatcgccgacagtaggaatagaagacggattattacgatattgctccaaatatcccatccatttgcttacactaggcgaacccattgtccagaattgatctccggctgcatcagaataggcctgcaaatattccatcaacggtgcctgttctggcaaattcatggcagttgcaaaggcaaagttattattataattcagttggaaagaagtttctcctttcggacgtttggtagtaaccaaaattacaccaccggcagcacgggcaccataaatggcagctgaagcagcatctttcaacactgtaaccgtttcaatatcctcaggattaaccatatccaagtctccttccacattgtcaattaaaatcaaaggcttgatagcactaccataagaaccatcatcatttttaatacctacagaataagcgccacgaatctggaatgacttacttttacctggagcattgccatcactagacacaaacaagccgggaaccgtaccttgcaatgcatcagcagcttgtgacaaaggacgattgcctatcacttcatccatcttgaccgaggcaacggctcctgtcaggtttgcttttttctgcgaaccgtatcccactaccaccacttcatctaaagtttcagtgtcctcacgtaataccacctgaatagtttttgtatcacgtacagttacctcttgagatttataaccaatataactgatttgtaacttcacaggaaattcagaaacttctaaagaaaattttccatcaaaatctgtgatacacccgttagtagatcccattaccacaacagaagcaccaataactggttcttttgccacatccataaccaatccggtaattgcattttgtcttgattgctggggtttataaacagaaatatgctccccttccactttataacggatatttttccctacaaacaacatctcaagcacctcttccacacttttatttttaacatcaatagatactttctcattcatattaatatcattattacgaacaaggaaagagtagccggtctgtttttcaatctcataaaaaacccgactcaaagccactgaacgctgttgtatagaaagttttgcctcctgaataggcaatgcggccatagtgacatttccccatagtagaaatgaaactatccatacaagagagaggcaatgccccctacgaactttacaaaagttttttttcatacttagaatttttagttaacaattatttaagcatgtacttttcacagtactttttatctatcagttaccggtctgtaataactattgtttttcctttctttctccacataaacttattatccacatctaaataagaaagaatttcatccaaagtcagattcgtatctatacttcctgaaaaatattcagtatacactttccgagactgcacaagtatctgtacatcatattttttcccgattgttttcaaaatatcaaataacttttcattaacaaataccagtcttcctgtagtccatgctgcttgagataccgcatctatctttctcatagacaataccttatcatttttattataaacagcttgctcatcaggagaaagaagaatattctttttagcatctgaagtagtgtaaacattcacactaccttccacaaggctcacttttatttccgcatcatcaggataagaagccacattaaatgttgtacctaatacttttatattcaattcccccgtatgaacaataaaaggcttgagcatatttctagaaactttgaaataagcctcacctgaaagaaaaactttccggtcagtccgctgctgcaaagaaacatcatactttaaaaccgtccccccattcagaaaaacaatggtactatcaggcaataataatttcgaactggccccctggggaacctcaatctgacaataagaaggagtaagaacttcttgaccagacgaatgatataaataaaagaatgttatactacaaccaatcagtaaagtccatatagcaacgcttctccaaacgcttattttacggaaaaaagaatgtttacgagaagaatagaaattcaatgtatcacacaattgctcaaagttttgctctttcctgcgtgcaaaccaagaagaggatgccaatgcataagaacgggctatttcacgatatttttcgcgacaagcattctcccttttcagtaatatagttagtttctgcatatcttcagacgagatttcgcctttcagataatccagcattattcgttcaaattcatctatttggctgttcattttatatctttggaattatctactatagataatacacaagcaacagacaaaacatttaagccaaaaacagatttttttcattctttttttagaaaagaaaaaataatagaatccctactctagatcccaccttttctcttattttatccatggcattttttacatgtactctgactgtattgactgaaatattatttttatctgcaatctcttgaggagtcagattggaataaagatattgctcaaaaatgaacctgcatttatcaggcaaggaagacactatattttggactgatttttccaaatcagctaattccatttcttgcaaaggcgaacactcggaagcacaaaattcttcttgatactcaagtaatgcttcacggtattcatctataattctttcacggctgtgaagcgaacggaggtaattcaaacacccgttctgaatagcacgtatcaaataagcatgaataggaaaagataactcaccacgcctataccatattttagcaaaagtttcattaactatatcttgcgcttccacagggttaaagatataagaattagcacaagcacagagatagacaaaatagctattatataaaacctcaaaagctttttcttctcctttgtttattctttcaatcaaatctttatctactatacttgcatccatctttattaagactattaatattgcaaatatagcatttcttaaaaacatcatgccaataaaactatttcttattaaaaaactctagtaataatcaactgaaaaaagaaataagttccagctcataatctgaagaataatacctaactttgtttccgacgaaaatcaaaccctaaataaaatgaacaaaaagctattattctccctgttactggcaggaacagctttcaccggacatgccgatgaggctaggttactccgtttccccgctaccaatggctccgacattgtcttttcttacgccggagatctgtacaaagcacctttgaatggaggagaagcacaaaagctgacttctcatatcggttatgaaatgttcgcacgtttttctccggatggaaaatcaattgctttcaccggtcaatatgacggtaacactgaagtatatctgattccaaccgatggaggcgaaccccaacggcttacctatacagcaacaaacagccgggatgacttaggagaccgaatgggtcccaataacattgtaatgacttggacaccagatggaaaaaacatagtctaccgcaatcgtatcagtgacggtttcgatggcaagctgtggagtatatcgaaaaacggaggaatgtccgaagtgattccattacccgaaggaggtttttgcagctattcccccgatggaaaaaagctggcttacaaccgggttatgcgagaattccgtaattggaaatattatcgcggtggcatggcagatgacatttggatttatgatccggctgccaagaaagtagagaatatcaccaataatattgcacaagatattatccctatgtggataggagaggaaatctactttatttccgatcgggatcgcaccatgaatatctttgtttataatatccggaccaaacaaactgaaaaagtaacccactatacggattatgatgtaaaattccccagcagtaacggacaaattattgtctacgaacatggaggatacctctataaactggatcctaaaacgcgcaaatcagaaaaaatctccatcacgctgacttcagacaatatctatgcccgaaaagaaatgaaacgggtagcagataacctgactgccgccagtctttcaccggatgggcaccgcctggcagtaactgcccgcggagaggtattcgatgttcctgccgaaaaaggggtaacccgtgatatcacccgcaccccgggagccaatgaacgggaaggggaatggagtccgaacggtaaacaaatagcctatatcagtgaccgtaccggtgaaactgaaatctggctgcaatctatcgaagggggtgatcccatccaactgacccaaaacaatgatacttatatccgccaactgatgtggagcccggacagcaagaaaatactttataccgaccgtaaaaaccgtatcgtagaagttgatattgcctcaaaagcgaaacggactgtcatgcagaatccggaaggagagttctatgaagtaaactattcaccagacagccagtggattacctatactaaatccggagctaataacatgagtgtcatttatgtataccatctgacttcaggtaaggaatatccggtaaccgaaaaatggtacaattcttcttcacctgttttcagcacagatggaaaatacctcatattcagttccgaaagagattttaatcccatttacagccagacagagtggaaccatgcctataatcgtatgggaggagtctatatggccatgctcgccaatgatacgccatcacctttattaccttcggatgaaatggtcagcatagaacaacaggcaactgatgctgtcaataaaaaaacggaagccacaaataatgcagttaaaattgatccggaaggcttgcccggaagactgattaaactgcctttacaagcaggtaactacgataatttctattcagacggtaaaaaagtgtggtatgccagtggtagaagtaccaaagtatatgatttgaccgaacaaaaagaagaaaccgtggccgaaggagcatatatggatgtagctgccaatcataggaaagcattgttctttaaaggaaataatctgtatatctgtgattttccatgcactaaagcctcattggaagagaacgtcaacttggacgacatgattgctcccattgactacagtcaggaatgggctcagatattcgatgaaacatggcgggctttccgtgacggattctatctggaaaatatgcatggagcagactggaatgcgattaaagaaaaatatgctgtattagttccccatgcaaaaacccgtctggacttgaactatatcatcggtgagatgattgccgagctggcttgcggacacgcttatgtgagtccgggtgaaataaaaggtcccgaacgtattccaatgggattactgggagctgaactgagtcgtgacaagggtggcttctaccgtattgacaaaattctaccgggtgcaatttacagtcagaaactgcgttctccccttacagaaccgggtatcggagtaaaagaaggagattatatcacagctattgatggcatttcaacagctactgttgataacatttacagtctgctggcaggcaaagccaatgtcttgactgaactaagcataaaccgtaccgcatcaagtaaaggagcacgtaaagtagtcattaaaccattagacaatgaatacccattgtatcattataactgggtacagaataatatcaaaaaagtggaagaagcaactaatggccgtgtaggctatgtctacattcccgatatgggaccggacggcctgaatgaattcgcccgctacttctatccccaactcgataaagaagccttgattattgatgaccgtgccaatggaggtggtaatgtatctccaatgattatcgaacgtttgcttcgtgaaccctatcgcctgaccatgcgtcgtggatcaactaaaatcggtaccattcctgatgcaacactagtggggccgaaagtattgctgatcaataaatactcggcttcagacggtgacttgttcccatggagtttcaaggcaaataagatcggtaaagttatcggtactcgtacatggggtggaattgtcggtatcagtggtccgttaccttatatggatggtacggatgtgcgtgttccgttctttaccaattatgatgcaaagaccggtcaatggatagtagaaaatcatggagtggaccctgatattctgattgataatgatccggtaaaagaacagtcaggtgaagaccagcagttgaataaagctattgaagtaattctacaagagctgaaggatcgcaaaccgttaccttctgttccggctccgagaacttataaagatttgggagtggaataaaaagcccgtaaattaaacatataaatgatgcagccgaaagaactataatctttcggctgcatcattataaatcttctaatcttaccgcctatatatcgtacaattgctatttgtacaaataaatataataatttttggaggtatatatattatatattcctccaaaaagtgtcatcaaaaagaaatctatatacataacaagaagttttttatttctgttctttccatatatctccccgactttcattatctttgcaatcacttaataacaaagatattaaataacaaaaaatagatcatggaatacaatttcagagagattgaaaagaaatggcagcaaagatgggcagagaaccatacctatcaagtgactgaagacgaaagcaaaaagaaattctacgtattgaatatgttcccttatccgtcgggagccggattgcacgtaggacatccgttgggatacatagccagtgatatttacgcccgttacaaacgcttgcaaggtttcaacgtgctgaacccgatgggatatgacgcatatggacttcctgcagaacaatacgctatacaaaccggacaacaccctgccatcaccactgtgaacaatatcaaccgctatcgtgaacagttggacaaaatcggcttctcttttgattggaaccgtgaagtacgtacttgtgaaccaggatattaccattggactcagtgggctttccaacaaatgttcaacagctattattgtaacgatacacagcaggcacgccccatcagcgaactaacggaagcatttgcccgatacggcaacgaaggactgaatgcggcttgcagcgaagaactcagctttacagccgaagaatggaatgccaaaagcgaaaaagaacaacaggaaatcctgatgaactaccgcattgcctatttgggagaaaccatggtgaactggtgcccgcaactaggaactgttcttgccaatgacgaagtggtggatggcgtttcggaacgcggcggtttccccgtcgttcagaaaaaaatgcgccaatggtgtttacgcgtatcggcttacgcacaacggctgctggacggactggacactgtggactggactgattcactgaaagaaacacagcgtaactggattggacgctcggaaggtacggaagtacaattcaaagtgaaagacagtgatattgaattcactatctttactacccgtgcagataccatgttcggtgtaaccttcatggtactggcgcccgaaagcgaactggttccccaacttactactgaagcacagaaagccgaagtggaagcctatctggaccgcaccaagaaacgtacggaacgtgaacgtatcgccgaccgccgcgtaaccggtgtattcagtggctcatacgccatcaatccgtttaccggcgaggctgttcccgtatggatcagtgattacgtattggcaggttatggaacaggcgccatcatggcggttcctgctcacgacagccgtgactacgcttttgcaaaacatttcaatctgcctatcgttccgttggtagaaggttgtgatgtaagtgaagaaagtttcgatgccaaagaaggtattgtttgcaactcaccccgcaaggatgtcactccttattgtgacctttctttaaacggactgaccatcaaagaagctatcgcagctaccaaagaatatgtgaaaacccacaatttgggacgcgtgaaagtgaattatcgtcttcgtgacgccatcttctcacgccagcgctattggggtgaaccgttccctgtatattacaaaaacggtatgccttatatgattgactcatctaaattgccgcttgaacttcccgaagtagctaagttcctgccaaccgaaacaggcgaacctccattgggacatgccaccaagtgggcttgggatgtagaaaaaggtgaagtcgtggaaaacaacttgattgacaacgtcactatattcccgcttgaactgaataccatgccgggcttcgcaggttcatccgcatactatctgcgctatatggacccacacaacgcacaagcactagtatcagaaaaggtagatcattactggcaaaatgtagatctctatgtaggcggtaccgaacatgctacgggtcacttgatttattctcgtttctggaacaagttcctgcatgatctgggcgtaagtatcaaggaagaaccattccaaaaattagtaaaccaaggaatgattcagggacgaagcaattttgtatatcgcatcaaagacaccaacacctttgtgtcattgaacctgaaagaccagtacgaaaccactccgctgcatgtggatgtgaatattgtatccaacgatattctggatgtagaagctttcaaagcatggcgtcctgagtataacgatgctgagtttatcctggaagatggaaaatatatctgcggatgggcggtagagaagatgagtaaatccatgtacaacgtagtcaatccggatatgattgtcgagaaatacggtgccgacacgctgcgtatgtacgaaatgttcctcggtccggtagaacagtccaaaccttgggataccaatggtattgacggtgttcaccgtttcttgaagaaactgtggaatctgttctatagccgcacagacgaattcttgcctgtagagggtgaaccgactaaagaagagttgaaagcaattcataagctgattaaaaaggtaaccggagatattgaaactttctcttacaacacttctatcagtgcattcatgatttgtgtaaacgaacttacttcattgaaatgtcgcaataaagaggtattgagcaatctcatcatcctgttagctccgttcgctccacattatgcagaagaactttgggaagctctgggaaataccaccagcgtatgcgatgcacaatggcctgcattcaatgaagattacctgaaagaagacactgtaaaatacactatctctttcaatggcaaagcacgtttcaccatggatttcgccgctgatgctgataacaataccattcagacaacagttatggcagatgaacaagcccagaaatggattgaaggaaaaaccccgaaaaaggtaatcatcgttcccaaaaaaattgtaaacatcgtattataatcgatactatccttgaggtgtgtcaaaagcagtaacttttgacacacctttctacttacattaaaaacaatcctcattaccatggaccaaatattaaaaatcaaactaggcagagaggtaaaagactatttatccattaccttcggactgatttgctatgcactgggatgggcggctttcttactgccttatcaaataactacaggcggagtaaccggtatttcagccattatatattatgttacaggcattgaaatccaggtttcttattttattatcaacgctgttttcttaggtttcgcattaaagatactaggacctaaattcagccttaaaaccatttatgccatctttatgctaacattcctattatggctctttcaagcattattgaagaacccggatggtacactgccgcaattgttaggaccgggacaagaattcatggcttgtgtagtaggtgccggcttgctgggatttggtatcggcattgttttctgcaataatggaagtaccggcggaacggatatcattgcctggattatcaataaatataaagatgtaacccttggccgcatgatgatgtattgtgatattgtcatcatatcctcctgttatttcatattccatgactggaaacgggtgttgtttggtttctgtgtattgtttattatgagcattgtgattgattatgttataaacagttcacgccaatccgtacagttccttattttctcgcgtaaacatgatgaaatagccgaaggaatcaccaaacaaatagatcgtggagttaccttattggatggtacaggatggtatagcaaacaaggaatcaaggtcgtagtggtactggcaaagaaaagccagtcactggatatattccgattggtgaaagatattgatcccaatgcatttatatcacaaagtaatgtggtaggagtgtatggcgaaggattcgacaaactaaaaataaagtaactaaaaaataatctcttccattgcttcactgtttctgcattgaaaaacagaacgatgaagcaatgataagattactacatatcggttaatctattttctcaaatttctattttatacaatatatgtctgcataaccaatgcccttgttccaccaaaggatgatcgaactctttttcaaaatgcattcctattttctgcatgacccgttcagagcgtttattgggtatggcagtgaacgaatataccgttttaaaaggtaaattatcactcgcataatccagacaggcagaagcggcttctgtggcatatccctttccccatgcatcccggcacaatcgccagcctatttccactccgggagtaaaatccgactcgaaagcaatattatgaaaacccacatagcctagaaaattctgagtttctttacattctacagcatacaaaccataaccatattcttcaaattctttccggatacgacaataaaaagccatcgtctcttcctctgtcaaagtagtgagaaagaattccattacttctttatcactgttcatacggacaaacggaagaatatcttcttcctcccagtcccgtaacaacaaatgaggagtttctatatataccatactatcaagtatcaaatgataccaacaaaaataatcaaaaattgaaaatacacatagcaaacaaattactatttaccttttcacctatattattctgtcaggaattatcttactttggttcattctcagtatctttgcattcaattaatatgatataaaatgaaaaagaaattagtatttgctacaaacaatgctcataaactggatgaaatatcctccattctaggagaaaaagttgaattattgagtttgaaagatatccattgccatgttgatatccccgaaactgctgatacgttggaaggcaatgcgatgctgaaagcggagtatatttataaaaactacggtttagactgttttgccgacgatacaggcctggaagtggaagctttgaatggtgctccgggtgtttattccgcccgttatgccggaggcgaaggacacaatgcggaagccaatatgcaaaaattattgcagaatatgcagggagtgcaaaatagaaaagcacaattccgcacagctatctgcctgattctggatggaaagaagcatttgttcgaaggaattgtaaaaggtgagattatcaaagaaaaacgaggttcgtcaggtttcggatacgaccctatctttgtgcccgaaggatataccaaaacttttgccgaactaggcaatgagacgaaaaacaaaatcagtcaccgtgcgctggccgtagagaaactttgccggtttctgaaggcgtaactatataaattagttatatcatttgtttacctctattgagcctcataaaaacaagtattctgttttcctttgaaaacaattttgacggaataataatttccatgagaaccattattccgtcaaaacaaatctttaatgaaacagaaatgtcactcctattccgatgataaatcctttccagaagaattcccctttacttttaagaataacagaaacgtcttttattaaccacatcttgttatcttttacaaaagtcataatcccagcttctccgaaatttccagcatcttcttgataggtttcactgcctcctcagctaccgcttcatccactgtcacttccggccattcatactttaacgtattgtacagcttctccagcgtattcagacgcatgaaattacattcattgcaagcgcaggtactgtcttcgggaggagcgggaataaagttcttctcaggacatttcttacgcatctcgtgcaaaataccgctttccgtagccacaataaagtcttttttgtcactggcaatggcatatttcaacaatcctgccgtagaagcaaccttgtcggccagtttggaaacggctcctttacattcgggatgaaccagaacagcagcgtcaggatactgttttttcaactccagtattttctccacagagaactgttcgtgcacatggcaggcaccatcccaaagcaacatattgcgtcctgtaatcgaattgatataattacccaaatttctatccggaccgaaaataatcttttcatctgccggaaaactttctacgatctgcttggcattggtagaagtgaccaccacatcggtcaccgctttaacagccgctgtagtgttaacatacgaaatcactgtataatccggatgctcttgaacaaatttagcaaactcatcagcaggacaactgtcggccaatgaacagcctgcattcaaatccggtaccagcacttttttatcaggacaaagaatcttagctgtttcacccataaagtgaacaccacacatcacaatgatatccgcatccgtttttgccgcccattgtgccagtgccaagctgtcacctacaaagtcggcaatatcttgtatttcgcccgactggtaatagtgacctaggataagcgcattcttttccttacgcaacttatcaatttcagttttcaaatccagagttttgtctaccagttcggtaacatacccttttttcaaccattcctctttattcattatatctatattttttctccttctttcaaaaaaagaaatatgggtattgataatatgcaaagttaaaaactttatggttatgaccacccaaaatagtgatttttatttccccgacttcaatgtacctgcattgctatcttcgttattcacacgtttctgcatggtttcatacttacgtccaaaactgatattccatgatacttttgccacaaacaggcggcagctctctttcacataccaccaattcttagaaggagccactttactgaacatttctcctcccattctgtaattatcaacaaatggattcaaagtcatcatcccgatattcaaacgcttgtatcgataggacaatcccaaggtatgaaaactctctccgtatgacaatgtttccccatagaaattattccgatgattttccatttgaaagaatccggaccatcttttataagatgccatcacttcggccctgtaataccaattggtatatgtatgatgataatccaaaccacgactatcataataatttataccggtagaaaaagaaaaagtcaaaatatctttcagaggaccgagtttcaattccaactcaggattcaatttctgccaacttaactgattggcattggtacggacaaaactgttattcttatctcgtatggtttcttccatgataggcctgtgctgatactgatacgacaaatgaacattaccactaaacaaacctttccagaaatctgcctccaactcatttttatatactgtgaatatctttaattccggatttccgcttctcacctgtaaagagtcaatcaattgtctcacatttcccatatcggacaaaccgggagatttacgtgaaatctgtccccggtaacggataaagacattatctgaaaattggtaccccaacctcaaacggggcaataacgaatacctgttatatccttcctctttctgtttgaatcgggaataactgccttgcagtccaaaagaataattgaaacgatccattttcccactgtattccacataagctgtcgcatgggtttcatgcatctttgtttcagatgactcgtttccaccataggtattgtccgccagactttgctgatatttcagtcctgcactcaatctgctcttcttggttattttcctttcataaataccctctcctataaatgagtatttatttcccgatacagtagaataaatatcagtcagcggttcatcactcttctcctccgtataactcctgtcactttgagtgtcaatataagtagtcacagcattgataatcaatgactggtcattgttcagtttacattgaaaatacaagtccaccgacggacgggaagtccggcccgtactatgttctttcatcatcaaaatttcttcaggcttctccaaaacatacagactgctttggttattctgcttgttcttattaaaagcccaccgtacagtggaattaaagaaccatttcccctgatcctgaaaactataattcaatcctatattatgtccataagtggaaattctactcggaatgccatcttccacccgtgtaaaggaagaaccatcctcatagcggaaagtttcccaattattacgccaataattatctaccgaacgataaacattattataattcaaaccgaattctgactttttatggtttatcttcaccataaaattattgtttccaaaaagtacgtgcggagaatcctgcgcatccaaagccacatagccaccggtttcatgccgtcttacaatgtaatcaatcacagcagccgtatgatccccatatcgcaaaccgggagcatcatgatattctatacgaatcacatcttcagtacgaagaaccaatatatcctgtatctcggcatttactccattcatccgtaactgtacatccccttcaccggaggatgttaccttgttacgcatttgatccacttgtattctgctcagcttcatctgctgcaataaagacagaccattgccggccgattttaactgatgtgctgtaggaaggataattttcctgtcggcggcatttatcacactggctcccgttaccaccacttcctttaacaggatcgattccggagatatcatgataacgcctaaatccttagaaacagctaaatgatccaatgatataatccgggaggtatatcccataccggaaatacaaagcagataacttccagcttggatattctccatcatgaaccttcctttactgtcggttactcctccggctataaatatagaatcctttgtctgcaatacgacattcgcaaattccaccgcttcattttctgaaacaacttttcctttaacctgtacattttgagcaaaaagtatgcagcacatacacaaaagtgatgtggcaaccaatattctttttatcatattctttatcttagtgcattagttaataaaaagaccgcgatcttctaccttttatttctgttacttagacgcaggaaattactacaggttacatttcaagaaacacaatgaacagttaccaacaatttctttgtatctattatatctatattttttctccttctttcaaaaaaagaaatatggtattaataataggctgtttatattgttagtaaaaaagagttctttctcttgcctgataagttatttatatataataccaaaatatgaataaataatcaaccggcttaaatactgataatacaggttttacttattctattaacatattgttgataagaatatgagttaaaaactttgtggttatgaacgcctgaaatagtgattaaattgtgttgatattgattgtttaagttatgtgattaatttttggattgttgattttaagtgtacattataccattatttgaaatatgcaagaaatacttttgaaatgatatcctcatcctttttacatgttttcaaccgttatcaacagggggatgtgaattagttattatcttttcttgtataaagaaatccatctgttttacaattgagtttaggactgaagtaaaaataaaaagagagtaggagagacttctttttcattatataggcgtaaagatcatagatttttatgtaagtttgtaaccgttaataataaagtagaaaatagagtatgaggaaactcaaaataacagaactgaaccggcttactgtagacgaattcaagaaagccgataagttgcctttagcagtggtgctggatgaagtacgcagtttacacaacatagggtcagtgtttcgcacatcggatgcatttttggtagattgcatttatttatgtggtattacagccactcctccccatcccgaaatgcataaaacagctttaggagctgagtattcggtggagtggagatataaaaagaatacgcttgatgccgttcaggaacttcatgatcaagggtttaccgtattggctatcgaacaggtggaaggcagtactttgctggataaactggaactggatgccgataaaaaatatgccatcgtaatgggaaatgaagtgaaaggggtacagcaggaagtggtcaatgcttgcgacggttgtgttgagattccccaatacggcacaaaacattcgttgaatgtatcggttaccacaggaattattttatgggagtttgccaataaattaatgaaattcagataataagagtaaaattcaaacagtaggaatcagttagatttgtccgttttcaactaacaataccacccgttcggtcagtcgatcctctccctccggatgatattctttcttcaggctggcaccaaaaagtgctgcaaaagtttgatagaatccggctttaaagggtcccataaaagcttttaccaattcataagaggaagaatccgtctgacggtttactaactttatcaacagtttaccctgtgaaaaggttaatttcttcataatcggtgtatattgctcttttagtcccttctctacgagtttcaggtgcttttccctggcttttttgtcaggcagtgtttctatatattcgtaagtttctatcacagcacggttaatttcacgggctaatggcagggttttcttcacattccttaccaggcggtagtattcccgtctttctttttcgtttttgaattttaatggtctgaaaatgtatacattaggtaactgtacagctggaatagtatctcctttgtatacacatacaggtaccatgtatccgtttatagtagtcgtttgttgctgggaataagcagcagcggctataaaggaaaaaaacaatgctataaagagtttccttttcatcttggtgcaaaagtagcaagaaatatgattactctgtatagtggataaaactatttaacttaaaacacgccaatgaattacaaaatgaacaggttgttaagagtaatgttaattatctgtattacaatacttttatcggtgcataacctgtgtgcgcaggaagtatgggaagaactggcagagcaattgatggatgaagatgaaaacagttcgtttcaatgggatactcactttgaggagctttccgaattacgtgaaaatcccatcaatatcaatacagcaactaaagagcaactggaacgttttccatttctctctgaccaactggtagagaatatattgtattatctgtacaaatatggtcctatgcttacccgcaatgagttatggatgattgaagatattgacaggcagactattcactatttactaccctttatttactttgaaactcctgaaaaagagcaatataaaccaaatataaagcgaatattgaaatacggtaaacaagagttatcaacacgtgtcgatattcctttttatacgaaggccgggtatcaacagtacccggcagaaactttaaaaaagaatccgaacaaacagtatttgggatatggatattatcataatctgcgatatagttttcattatcgggatcagatttatgcaggaattactgctgaaaaggatgcaggagaacctttctttaccggacaaaataaaaaaggttatgatttttattcactatacttgttaattcgtaatataggtcatatcaagactttagctcttggtaattaccgtgtcagctatggttatggactagttatcaacactgatttcgggatgggaaaaacagctacactctctactttgggaaataagagccggggcatacgcaagcattcttctaccgatgaatataactattttcaaggaatggcagtcagctataagttggcgaaaagatggacattggatggtttctattcttatcggaagatggatggtattgttgataaccagtttataagatcgttgaaaaaagatggatatcaccggttgtatcgtgagtttgagaagaaaaatacattaactaatcagttggttggcagtaatttaaattataatggaaagtactgtgagttaggattaacagctgtttataatgttttcaacaagccgttgaatcctgagaagaagtactataatatttattatccccgtggaaaggacttttataatgtgggaggagattataaattcttttggaaacgcttctctttattgggtgaaacggctatagacaaatgtggtacttgggcaaccatgaatatgttacgttattcaccgaaaggaggaacacagttaatagttatgaacaggtattatgatgccaaatatcaatcggtttatgctcgttctataggagagggaagtacggtacaaaatgagagtggattttatataggattggaaaccagtattttaaagtatatcaaaatgacctgttatggtgattttttctatttcccttggaagaaatatttagtaagcaaagcaggaaccaaaggattggatggattactccaattaagttattcacctacttatgaactggaaatgtttataagatatcgttataaaaagaaggaaaaggacttcactgctgcggataaaaccaagcaaactattccatctattcagcagaaatgccgataccaattgaattatagcgtgaaagataaactgacattgaaaaccatagcggattatgtacgcatcaactttcgtgggcaatctgcttccaatggttttctggtttctcaaagtgctgcttatacatttcatttgcttcctcttcagcttgatttgagtgccgcatggtttaatacggatgactataattcccgtcttactatctatgaaaagagtgtgctctatgctttttccatgccttcattctattataaaggtatgcgtgtggcagtgaacgcccgttatgaattgaataaacacattatcttgcaggccaagtacggaactacccattatttcaatcgggataagataagttccgctttggaggaaattgacggcagtacaaagagtgacctttatttgcagttgagactgaaattttgaaaaacattctgtatttttgtactgttatcaactgaaaaaagaactatgtcaacagtcatttatccttctcccatcttcggtccggtacatagtcgtcgtttgggagtgtctttaggaatcaatcttcttcctgaagatggtaaattttgtaccttcgattgcatttattgcgaatgtggttttaatgaagatcatcgtccccaaaagaaactgcctactcgcgagcaggttcgtgaggctttggaagcccgtttgattgatatgcagcaaaatggtcctaaaccggatgtgctgacttttgccggtaatggcgaaccgacggctcatcctcactttgcaggaattatagaggatactttggcattgcgtgatatatattttcctcaggcaaaagtgagtgtattgagtaattctacttttattcacaaaccggaggtatttgatgcattgaataagatagataataatatattgaagctggatactattgatacggattatattcgattgacagaccgcccgaccgggcactatgatgtacggaaaattataaaagggatgaaagctttcaaaggtaatctgattattcagaccatgttcatgaaaggcaaatatcaagggcaggatgtggataatacttcagatcggtatgtgctgccctggctggaaacggtgaaagagattgctccccgtcaggtgatgatttacaccatcgaccgtgaaacgcccgatcatgatttggaaaaggctactcatgaggaattggacagaataggaaaattgataaaggattccggcattccggtatcggtctcgtattgagaaaaaagtaagttgacttcaaagggcaagtaagttgacttactttgccgatgaagtgaacttactttgctcatgaacatatcttactttttcaggtcactattaaaacatataatttattcctggatatttttcaaagactggagatacgttgtttcacatacttgcaattgaatggatttgaataataatggaatatacttctatccctgattataatgatggaagctttaatctttatcagaacgaactgatgaactttttcatctttctgaccaaggtacatccagcttttattcttgacaagtcattgaaagcttaatgctgtctgtttgtcctgtccgcttgcgatgagctttgtgatatgaataaataacatcactttagccgatttccagctgagaattaatgaattgttagttcttttgcaggatgcccatacttttgtgaatatagaaccgttgtcgctatatccattttctgtccgctattttaacgggaatttttatttatactccattttttggaacacatgattcaggatatgaatcaaaggggagtttctttgctggttgttgatatgcggtataatgggggaggtaacagccttttaggaaatatgctgttggaggcattgaatattcatttatctatttccataagctatggaaatacaacaaacacgaagaaagcacttggctatatggcaggaagggcttagggatgcggataaggtcttttaatgataaatctgatttcaagattttaaaacaccagtgaggagtatgggggcattttacacttatttactgaaaaaaggatattggctttctattcctgtccctcattagcagaatagaatcaaaaaggagagcatttattttagtccataatgctctcctttcttattttatttttctataatagcctttgctttctccaaagccacattgatattaggacagatattttcttttcccagcagttcattaaatcctgatttttcaagaatttgatgcactttttcattcactcccgagagcacaatctgaatattttctttcttagacatttcgcatagattagtcaggttgtgaataccggtagaatcaatgaatggtactttacgcatacgtacgatccgtactttgggacggtcgcccagttcggacatgatttcctcaaacttggtagcgataccaaagaagtagggaccgttgatttcatatacttccacacctttgggaaccatgagatgttcttcgtgcacttccagatcggattcattattggggtcgatttcatttttgataaccgatatttctgttgtttccatgacacgtttcatgaacaatacacaggcaatgagcaaacccacttcaatagctacggtcaaatcgaagataacagtcaagaagaaagtgatcaacaatacggtgacgtctgatttcggattcttcagcaacgctttgaaagtacgccagccgctcatgttataggaaacaatcaccaatacacctgccagacaggccatcgggatatattgtgccagaggcatcaggaacaagagaatcagcaacagaatgactgcatgaatgatacctgcaacaggtgattttccaccgttgttgatattggtcatggtacgtgcgatggctcctgtagcaggaataccgccaaacagcggagcgataatattggctgcgccctgggctatcagttccgtgtttgaatcgtggcggtcaccaatgacaccatcggctacggcagcagacaacagagattctatggctcccagtacagcaatggtgatggcaaccggaaataaattcttgatagcttcccaatttaattcgggcactactgcatccggcagctgtgactgaatggtaaaacggtcgccaatggtgtcgatacaagtgattccgccatatgttttcatcaggtacacggcaatggttactacaatgatggcaatcagtgaacctggaatcttttttgagaaccggggagtcagtgcgataatcaggacgctgactatgctgacaatggcgttccaccaattaacagtatcaaaatgacggaaatacatcatccatttacctatgaagtctcccggtactttttctcctccgaagttcagtccgaagatatcggcaatctgtgtcgtaaagatggtaacggcaataccactggtaaatcctacaataatgggataaggaatgaatttgataacagctcccagcttgaatacacctaataaaataaggagtactcctgccataagagttgctactgttaatccgctgatgccgtattcttggatgattccatagataattacgataaatgctccggtaggtccgcctatctgtactttgcttcctcctaataaagagatgataaatcctgctacaatagcagtgatgatgcctttttctggggaaactcccgaagcgataccaaatgcgatagccagtggaagtgcaacaatacctacgataattccggccatgaggtcggccatgaagctctcttttgaataattctgtagggtagtgaagagcttcggtttgaattcaaatgctttcatttgtcaactactttatgctatgattttaaacgagttgcaaaagtagataaaattaatgtataaattaaggtattattctatttaaattcgtatttttgttattcatagggtgttttgttgatggtaatggtgcgttgggcggtagaatcatttgtgatactggttacatctcctctcgtagtgaagtaaacgtaatttcctttatcgtaaaaacgatataccttgcaaccgtcatgttcaaacagatagctgacagtgtaagtggagttgttttcagactctccgatttttaacggtatggacgcacatgaattaaatcctattatagtaaggaggggaaaagtgaataatttgatgatgtttttcataatggaaaatgttaatgttgttgtgaacacaaatataggtgttcttgtttattttatataaagtgaacgtttaattaaatataaaaacgtaattgtaatgaatacaactttgaaataaaatatatatctttgtgtcatcaacagatgatcaaataatactaattaataaaactaacaattatggctaaaagcgtaaaaggtacacagacagagaaaaacttgctgacttcatttgcaggtgaatcacaggctagaatgcgttatacttactttgcaagtacagcaaagaaggaaggttatgaacaaatagcagctatttttacagaaacagccgatcaggaaaaagaacatgcaaaacgtatgtttaaatggttggaaggcggtatggtagaaattactgccagctatcctgcaggtatcattggtaccactatggaaaatttgaaagctgccgctgccggtgaaaatgaagaatggactactgattaccctcactttgctgatgtggccgatcaggaaggttttcctgctatcgctactatgtatcgcagaatcgctgaagctgaaaaggggcatgaggaaagatatctggctttattgaagaatgtggaagaaggcacagtattcaagaaagcggaagaaactgtatggcagtgccgtaactgcggttacatttatgtaggtacggaagctcctgaagtatgtcctgcatgtctgcatccgcaagcttatttcgaagtgaagaagaataattattgattgaaataaaaccactcgttcatcatggatccggtttctctgaaaaggggaaaccggattttttatttttaggaaatgatttttgattggtttttattcttctcttttcccgtttacaaattcccccggtttcatgccgaactgtttttggaaacatttggagaaataagacggattattgaatcctaccatataacagatttcattgatgcgatatttgttttctgccagcaagatcgctgcttttttcaaacgtaccacttgaatcagttcattaggggtgatattggccaatgtctttattttggcaaacagacccgaacggctgatacataatttttcggccaggaaatctacggataattccggattggagaaattcttttctatgatttcattcatacgggtaaggaacttgtcgtccatagaattattggcaatgctgttcagcggaaccaacggcatcttcgagaatttctgacgcagcagattacgcaagtctaccagattcttgatacatgcttccaagtattgcatggagaaaggtttctctatgtaggcatctgcaccacaatccataccttctatcttggagttggtatctgtcttggccgttagcaggatgaagggtatatgactggtagcctggttagtccttattgctttgcagaattccactccgtccatgcgtggcatcatccagtcgcttacaatgagtgtcacttcgttttctttcagtttattcagtgcttctataccgtcttctgcggtaagtatgctgtatttatcagccagactactcgaaaggaaattcaacatttcctcattatcatccacaatcagcatggttggtttatgtttgataggagaaccggagaggtcctcttgcaagattccttcgggaatggctgggttgttcaatagtgatgtgcccgtatcctgtggcaggacttgtgcttgttctataggcaacgttacgataaaagatgatcctttgttaacctcggattccacttcaatacagccattgtgtgattctacgatacttttgacaatgctgaggccgatacctgttcccggcttgttatccatagcctgatagaacggatggaatatcttcttttgttcttctttgctgatccctatgccgttatctgtcactcggattataaaagtatgttgttccggctgtacgatacaggtaagagtaacttcatcttttgtgtatttactggcattggtcaacagattgctgactagtttggttaccgcctcactgtctactatagccgtgaaatctgcttcaggatatttcacagtaagccgtgctccatgttgggcgatgaaaggttcgaaacgttcacaaaccgctttgagcagttggtggatattttgggaagcaaacttcattttcattccttcctgttccaccttccggaaatccagcaattggtttaccaggaacagcagacgctggctgttacggtcaataatattcagatcgtcgcgtactgtagacggcagggacacgggagatttcattattttctccaaaggtcctatgataagggataccggtgtgcgtatttcgtgggctatcatggtgaagaacttgattttggcttcgtgtacttctttttccttgttggcgttcagtttgtttatttcagccgtatgtttcttctctgtccgtttgatgatgaagcggatgacgaatccgaaagctatgcaaaccaatacaaaatagagcagtttggaagcggtggaccaatagaaaggagggtggatggtgattttcagactggttcctttttcattccatattccgtcattattggtcgcctttactttgaaaagataggttcctgcgggcaaattggtgtaagtggccttattttgggagcctacatagttccagtctttgtcaaatccttccagtttataggcgtatttgtttttattgggggtgcaatagcttaaagaggcataaagcaagctgaatgcattttctttataggatagctccagttcttccaactggttgagagattttggaagcagtttgtttcctacaggaatttgtttattaaatatttctagtgcagtaatgactaccggaggaagcatcacatttgtcttaatctgatgggggtagaaagcattgaatccgtttactgagccgatatagatttttccatccgatgcttttaaggcagcattaggtaggaattgttcactttgcagtccgtcgcttttagtaaatactcggcaaccttctccaggggtgtagcgcactagccctttggtggtggtgagccacaatatgcgttggtcttcgatgatgctgcatatattgtgactgggaatttcaagaggtaaagtttcgaatgcatcttcttccgcattgtatttgcagagcccgttcatggttcccacccacatctctccgtttgtgtcaatcagtacgcagttcacttggttgtttgccagtgagttcggatttttatggtcatgtatatagttcttccatatctgtttttctggatggtatttaaataatcccttgccttgggtggagaaccagagatttcctttggtatcctggtcaatgtcaatggtcagtgcgtccaagtctttaattcgggtgaaattatctttttcccggttatatagatttactccggacatggaggtgacccatattctctcttttctgtctttgaatatggcataagaactggttccgtccagtgaggcgggattatcctgataggcagaatatgttttaaaagttcccgtttgcagatttaatacgtttacccctccagtataagtaccgatccataaattatcatcgtccatacaaagtgcatgtacattgtgataggacagactgttttttccctccaagggcaaataatgggaaaattttctattttgaggagaaaagcagtttaaccctccgtcatccgaagcgatccacacatctccgttagagtcttcgcagaaccgtccgatgactgttccgttaacagaattggaaaaacgtgagtggacaaaactttcgaattgtccagtattgggtgaaatataatttactcctccatagtaagttccgatccatattccaccttcatgatcttttataataggataaacaaaacggttggacaatgaatgtgggtttgtttcatcttctgtaaacaattgatattcctctgtaatggtattgaataacagaagcccgtcatccgagcctatgagtagctggtgaggggcatattccatgatagaatgaatatgggtggcaccttttccgtctgtgggatgcagataagtagtggcctttccgctgtatttatcgattttttgcaaaccacactcccaggttcctaaccacagtgtatgttccgagtcttccaacatgaccaatgcgtttgagtcatgctttccgctttcataggagagcggaaaagtctcgaatttattttctgctttattcagtttgaaaagacctgagtttccccaattggtaatggcccatatttggttttcactatccaccagtacacttgccattaaaccatttgcgtttttaaattcgtattgctccaagtggttggtgatagtgttgtatttgaatattccttgtcctaccgtagtgaaccataggtttttgtctttatcttcgacaatatggttcgtatttgtttcaatatggatattttgggaggtggccagtacaaaaggcattatatcttctgtttcgtaatcatagatatatatgccttcgtctgtacctatccatatcttattgagggtgctgtataaagatgaaatagcttcattagctcccctatctttcagtctatagagttttacagtagtaccgtcatagcggttcagtccttcatccgttcctatccatagaaaaccgtatttatcttgcattaaagcacgtaccgaattggatgatagtccgtcttctacagaaaaatgacggaaacagaggtcattggacgctgcaaacagaatcatcggcatcagtaagttcaatagcaataggactagtcttttcatagtattttcttcttattttctaaatcttatgcaagattactatttttctgagaaagaaaagagaaaattcgaagaaaaagtgaggattccagatgaatctttcaatagaccttttcagacattctctaaaagctagcttatcataatcctgctgcagattttaagcggctgatagctgtttctatcatatcatgtgtgccactgccgtctgctacgtattttatgaccatttcagtgaatgcaacagcgtcttttaatgtcggatctgtagaatcgtctatggtgcctacgcgccttaatagagcagataaaggtcttaaatcttccatttcgggtaagttacccggtctcattgtattgatgacggtattcaaactagctactatggcattgacttctccttgggagtagtttttatccttattaaaatatacattttgggcatgttccaatgtacgtttcaaacgggtaaacccgaaatgagcccaaggagcaaattcaggaatcttgactgcgagagcattccatttttcttggtttgtttggcgttccatagctatattaagtaactcctttaattctgttttatctacattatttgccagtaccaaagaagcggtggcatcttgtagtgataaagtttgtttgtcaataacggtttgtaaatcaatgttatccattacttcatgggcgctttcaagagtagcttgcaatgttttaaaactatcagtagtataaaggtccggattacattttttagctatatggatactggcttcaagattgctcttatctaatcgggaggcgactaatgattctatggccttgtcaatattgtctacacaagtagaaatggtagtttctgtcagaggagatattttcattagtttctctccctcttgtatagcggttgttagtttggcgaaacttgcttttgtgtaatggcttttactaaatgccgtagtttctcgtaattttgccgacagagccattttcagttctacagtaggatctttaatatgattgatgcggaagtaatgagttgtatggtcatggcgataataatctggttggaaagttcgtccaccttgcatcagtgtatataaatttcctgtagtaccggtttgcggaccgttaggttcaacaacggtaatactggcaagacgtgagtctatattgagtgttgcttccgtccaattagtgatatcggtagctgtcatggcaaacggtccatgcattaatgtacctacccaagccgtttcaagttggtgtccgtctttacttgctatctcagccggtagcttgtcgggaccatagtctatatgtttggtgaatggcattgtaatttctactatatcattttctttccattgccgggtaggtattaccgcgtatgaacaaggttgataatgagtggcaatagagattccatttagttttacatcaaagccgtcggtggcccaataaggtactcgcagtttcatggcaaatcgggcttctccggcagtaactttaattgtggagctttttgctggccacaaacattcctgttgtaaagtgatatttttctcttcccaatggagtgtggtaggcatataaagggctacccacaatgtattgtccgaaacaaagtaggttgcttcctgatattttacatgattttcagatcccgtacctccgcagcaggtagattgcggagtttcgttgccccatggtttcgatgcatttagtcctacggcatattgataagtagtctgatagtgttcagggtgtaatgagccgattatttggttgtaaagtgtccgttcgtaataatccatgtaacgggcatcgtccggattaaaacagttgaggtcttttgttaattttagcaagttatatgcacaacaagtttcattgatatgtggatttgagtgactctctccttcagatacgccattcatggccatacttactatttgggtatagggctgtctgaacatttcgccattacccacaccgccggtagaataacgataacttccttgtattaaattccagaaattatgggatacatgataataaaatgtatcattgttacttaaataacttctcagtgcaccgatgatcatagggatatgctgattggcgtgtctgttacgtatatcatcaatattctttgaaagcggttcgtaaaaggccggactatcaaaacaattggatgcttctatcagacgcgccttctcttcaggggcgctgaccatttctgaaagacgtgctaaagattctcccatacctcccacttcacctgcaatgtacatgttccacatttcataacgattgccgggatgtgtcctgcgttcttcttgtgttccgtctttttttacataagtgcggtagtgcattctattccatacccacagacccatatctttggctatgagcaatgctttgtcggcaatgcttttatcatccatataagttgcaatatctatcagacccgctaactgtttgtgaatggagtaatagggagcccatacccagtccgaattgttatatgcacgatacatctctatcagtgcgggatggtgcggggggatcgcatttagataaccatagccataagtagcccattttgttttatgttcatcaaaagcttcccatgtacctttcatctttttcaattcttcttcaggggcaaaatcacgggcttcgagataccttcctaattcttcgctccatacgaatgtacgctcctgacattcgcgcagttcattcaccattcgggtgatgttacggcgtaaaatttctttatgcgaaggatttgttgcagcggcataggcaagggccagtgcggacatatagtgtccggaaccatgtccttttaatttagtttcaggtgagtcccatccgtcagaccgggtatatccttcggtactcagtccataagtgtcgcgataattatatagctgttggcttacatcccaactgataatctctttaatggcaagatcacgattggaggtcaggcgattgttgccgttaatctttacattgtttaaggggatagtatgggctattagcttgggggaaattgtatttttagtgtctaccacctctattttagcagtgataggatatccgttttctgtagtatcgtctcctataatgaatccgtttattgtgtattggcttccaatgggataaactttatcgtcagcctctgattgttctgtggataaagcggaattggaccatttagtttgacggtattcaccttgtccgtctgaataagtcacccatacttgataaggtaattgaggaacagttcccacaggacaatagatcacgatgggttgtacagaagttatgcttcgtacttcgataacatttgtctgtaagatggatgttgctgttttattaggatttagtgtatacgcctcaatgggtattgttgtcaatagggataatcctgtaaagagagtaaaagataaatatctgttcatttccatgagcatattttaagtaatgattttataagagatgggaatataaagcccggttctaataacttaaaccgggctggaaaataaatatttgtttaaataattagcaactattgagaagaaagaaggttgctttctatcacattatttcttatttaccggcatagcctggattttgctgtaaattagggtttgtattaagatgatctaaatgaatcgggaacaggatagagttgccattcaagtcattggcagtcggagtatgattaaaccaacttttcttctgataggttccgaagcgaatcatatccgtacgtcgacgggcctcggctgcaaattcccatccccattcatcataaagtccgcctaattctacgacttctgtattacccgcatcatcaatctgacctttttcgtcaagcgtaccatagttaatgtgtgtatcgccttttaaccaagctgcatcaaccgttgctttttccggatgagccgattcacggaatgcacgctcacggatctgtgatacgatatgggctgcttcggtttcgttttgtcctaagcggagcagacattctgctttcatcagcaatacttcagtataacggaaataagggaagtcgttgcttagaaggcttttagctcctaccttaatttcgtattttcctacccgataaccgtcatctgtgtctgttttgtaaatactgggtagcttattggggaaagtggtgatcagtactccgtccgggctgtactggtcaccttgcagccatgtatattttaaccgcatatcatcaggatcatagctgttaatgaactgagggtttgctgctgaacctccccatggggtggtttgcatattgaagaccttacgactgtttgaagatagaaatttcatgtgggctccaaaaacaggaccattgttgtccccttcattataaacttcatcataaggaatggcaaagatcgtttccacacatccggagttttctgttttgaagatatctgtgtagtttgtttctaaactaaacaaaccgctgttaatgatatcgttacattgttccagacattcgttccacattggagttcctgtatagaccccagcattcagatacatacgtgccatcaagcatttggccccccattgagtgagtctgccataagtggatttattgacttcagtaggcaaattgggcattacttctttcagttcattgataatgaagtcaaaaacttgtttacgagtagattgaaccggaacctcttcactgaaactggtttgtataggaatatttccatgtgtatcgcaaagaatggagtaccaaagtgcacgtactccttttacctcagctacgactttaggtttactttcttctgtaaaaaaaccttcatcggcacgttttaatattttattggcattggcgatgcctttatagcaatagtcccaaatactttggggctgtccttgctggttgtcccaagtgtgtttgtgcatttgcttgtaagtacctccgtcatcccagccgttcgggcgggtaggtgtgacaattacatcgcccgattcttcctgtaggtcaaacaagccataccagtccatcacaaagcgtaattgtgaataggtggtagccaacaaggctatctcatcggcttcggttggtacatagtcttcttcaatgatttcagaataaggctcctcatccaaattaaagcaactgcttatactgagcatggcagatgcacagagtgcataaacaccatatttaaatagtttcataactgttcttttttgtttaattagatttagaatgtaagattaactccaaaagtataagtgcgattggtaggatacttgtcgcgattgtcagtaccggcatccaataatccataggtgttgctgctcaatggtacttccggatccatacccttgtaaccggtaatggtagctagattcaatactgaagcatagatacgtaggtttttgatgatatgctgtttggatagtttgaaggtataccccaaagtcacattgtcaattttccagtaatcaccgtcctctacgtaatagctgacatagcgttggtcatctttcaattgggttttgccatatactttgtcaaaagcagaattcaggcggttgtactggatttcaggttttgcattttcataatacatacgttggtaattcaaaatctggaagccgaaagcaccacgcatatttatacttaaatcgaaattaaagaaattgaaggtattgttccagttcagataatgtttaggaataccattacctaatacttgccagtcagtggcatcggtttcctcggctaaaacatgttcaccttttttgttttctaccaaccatagtccgtcatctgtaatatcaaccgatttcaaaccatagaaagtacctataggcttgcctacttggacgatatgggtagtggtttgaatgggttctccggtataccctgtatagaaataatcttggtccatcgagaatttctcgctggatagtgcaacgaccttgtttgaattagtagaataggacacattggtattccaagtgaatttttctgtctggataggcgtagcacgaattagaatttcaagtcctttattttccatttccgatgcattggctagcatggttggatacatataaggcggaacaggaacctcgtagtcccaaagagcatcttttgttctacgtatatagtagtcaacggttccacccaatcgtcctcctaggacatcccaatccagacctacattgaattcgtgtttcttttcccaacgcaggtcagcgttgttgttacggattgtttccaatgctttgacccatgttccattgtacaggaaagcgccattataattcaaacttgagagtgatgtgtacgggtcggctacattgattccggtcacaccgtatcccacgcgaagtttcaggttatccatccaattcacatttttcataaaattctctctgttaattctccatcctaaagagatgccggggaaattaccccacttatgatctttaccgaacttggaagagccttcatgacgcaaagaagccatcaataagtagcggtcattgaaattgtaactgacacgggtgaataatccgattaatttatcagaatttttataactggtcatggaagcttcaccacgtttcaaggccatacctgcttccattttgttgtaagaataagcatcggtaggaaaatcgtagttggacatggacaggttagagttggtgttgtcttcatagttataacctatcaatacactgacattgtgcttgccgaatgctttctgaaagttggccgtcaattctatcagattattatcaaaatcagaatcataacgatatgcatagccgttacggccactcttggttgtagatacatgtttcttggtttggtaatatccatcggtagaagtcgtactccggcgggcatacatggctttcaaggtcaaagattcaatagggcggaaagtcaggctaccattgaaacggatgtttttacgtttcatttcaccaattgtttcgcggatataacttacaggattatcataaaaatacaagtcgcgctcaaaccagtcaccgttctcatcttttacaggttctgtaggattgtgaatcaaagcctgtcgataagcgtatgtattccaactgcgaggcatggtatgttggctgacgaatgtactgacattggctgtcaatttattgtcatacatagagtgagtgatgtccatacgaccgtttatagcttcaaagtcagtctttataaaagtaccttgccggttggtatagttgatggaggctgtataattggtatttttactaccacctcttaaggataagttgtgtgaatgagaaacagctgtgcgggtcagttcacccagccaatcggtattggcttcgaaatctttcaagttagctccgttgaaagtatatccttcattccatttctgacgaaggtcatcagcatccatgaaatcaggtctgtttaaaatgtttgatacagaaacatatccattataatcaatggtgggagccatttctttacgactttgtttggttgtaataataattacgccatttgtaccacgtgtaccataaatggcagtagccgaaccgtcttttaatacatcgatggactcaacatcttcaggggctactgtattcagacttcctggcactccgtcaactaatactaatggtgaagttccaccttttaaagatgaaataccacgtagcataatttgtgtgttgccggtaggatctcctgaaggtaaagaaatattcagccctgctaccttaccttgtatcagctggcctgcatcggttaccgcccccttcacaaaactttctgattttacacttgaaatagcactggtcacatcaccctttcgctgcgtaccataaccgatcacaaccacttcatccatcagttcggaatcgtcttgcatggtaatatctttcttaccaccatttccgactggaatttcctgagtctgataaccacctatcatcttcatatgccatcttattttttagagacatttactgaatatccctttttaaggcaagccattaataataatgtaaaataaaaaagcgcaactaaataataattagtcgcgctatctgatatatcatacaaaagaaattcctccgctttatatgatatccggttataaggtaggatcaatcttcttgaacttcgaaatcatctttacctactccgcaaagagggcaaacccaatcatctggaatatcttcaaatgctgttcccggagcgattccaccttcaggatctccttctgccgggtcataaacccacccacatactgtgcaaacgtactttttcataattgtctctgttttatgttttaaatattctttaaatacataacaaatatacaaggaaattgtttacttgcaaactatcccactaatatttttttaagctcttccattccttcggacgcacctttctgaattacatgcactttacgtcccgatgcaatgggcacctgcttaggatctattaaataaacaggagtgcgggcaggcacataattcaacaaaccggcagcaggatatacattaagcgaagttcctataattaaaaagatatcagctgtttcagcatattcaattgcagtttcaatcataggaacagattcaccaaaccatacaatgaacggacgaaactgggaaccgtctccggccaagtctcccaaatgtatctcatattcttccggctttaattctttaatataagctggattattaggttgccaactagatgtcaccttggtcagttcgccatgtaaatgaataatatgcgaacttccggcacgctcatgcaaattatcaatattttgagtgataacagtcacattaaagaacttttccatctcagaaaccagttcatgcccccggttaggctttacagcaagcaactgtttacgacgctcattataaaaatcaatcaccaatttagggtttgccgcatacccttccggagtagccacttgttccaccggatactgatcccataaaccacctgcatcacgaaatgtactgataccgctttctgcactcattccagcacctgttaaaactactaaattcttcatttctagtcctcctcttttaactaaacacacaaaaataagaaaaattaaattgttaaaaacagattcattcaaataaaacacctacctttgtgcgttttgtataaaacatcttataaaataaatagttatggataaattcagttacgccatcggccttggtattggccagaatttattgagcatgggtgctcaaagtattaatgttgaagactttgctcaagcaatcaaagacgtattagatagaaaagaaacggctatcagccacaacgaagcacgtgaaatcgtaaacaagtactttgaagagctggaaaccaaattgaatgcagagaatattgaaaagggaaaatcatttttgaaggaaaacgcaaaaagaccgggggtcgtgacacttcccagcggcttacagtacgaagttatcacagaaggtaacggaaaaaaaccgagtgcaaccgaccgtgtaaaatgccattatgaaggtaccttgattgatgggactttgtttgacagttctatcaaacgcggcgaaccggctatctttggtgtgaaccaagtaatcaaaggatgggtggaagcactccaactgatgactgaaggtgctaaatggaaacttttcattccttcagaactagcctatggagcacaacaggcaggagaaatgattcctcctcacagcacattgatttttgaagtagaattaatcgaagtattataattattaaagcatttaaggcaaatgaaaaaaattagtttttttgtagcaatcgctgctgcagccagcttggcgtcttgtacagcccaagcaccgaaagcaaacatgaagaatgacgtagactcactttcttacatgatgggtatcaccaacacgcaaggtctggatatgtatatgagccaacaactgggcgttgacacaacctatatggccgacttcatcagaggtgttaaagaaggtagcagcaagacaagtcctaaagatgttgcttatatggcaggtcttcagattggtcaacaagttggtggacgtatgttcgatatgatgagccaacgtattttcggaaatgactctactcaaagtttaagtaaagaaaacttcctggcaggtttcatggctgctttgcagaaaaaaggcatgaatgttactatggaagaagccaacgcctacgttcagtctaaagcagaagcaatcaaaacaaaagctactgaagcccagttcgctgaaaataaggctgccggtgaaaaattcctagctgaaaatgcaaagaaagagggtgttaaaactacatcaagcggattgcaatataagataattaaagaaggtaacggcgctgttcctaccgattcttctaaagtaaaagtaaactataaaggtactttgattgacggaactcagttcgacagttcatatgatcgtaaagaaccgactactttccgtgctaatcaagtaatcaaaggatggactgaagcactgacaatgatgccagtaggttctaaatgggaactttacatccctcaagacttggcttatggtgcacgtgaagccggtcagattaaacctttctctactttgattttcgaagtagaactggttggaatcgaaaaataacctcattttaatacgatttacaaaaaagcgtggaacattcgtgtctcacgcttttcttttaacttgtctttctacaaatcaattttttttcctttatatctgtacgtgcctcaacaacatttactacataatcgcctaatttttcgcattcgctgataatatccatataatgaacccccgtctgataattatattccttattattcacatccaatacattctgatccttcaactggttgcggtaattgtttctctcattctctatattaaatgatttgttaggatcaaccaaatgatattcgttttcttccaaagataccatttgttgcagtggaagattgtacgaaggcagtcacaaatgcacctgtcaacaatccggtgaagcgattcgtggtcatagcacccaaaatatggcgcaaatgcccacctgtcggtttttgcaaagcctcactcacggttttcataccatacatcagaagtaccagtgagcctatcagtttcaaaaaaaacaaatattgacatgtagattctcttttatttagactctcttctttcttacactttattaaaagacacagaggcacaaagtatttaacccatcataggttaaaccttgcacctctgcacctattctgttcaccatagccctttcaggtcaggatttcttttccttcacattgctactggcttccaccacatttactacataatcgcccagtttttcacattctccaataatatccatatagtgcacccccatctgataatcatactccttattattcacatccagcacattttggttctttagctgattacgatagttatttatttcattctctatattaaacgatttattcacatctaccacatgatgctcatcttccaccaacgaaatcatctgagacaaagcatcatcagtcaactggaacatctgatgaatatgatcatactgtttcggagtaaaatccatatcactgcgatgtttacgattgatagtacgtgccaaattataacagctgtccccgatactttctatttcagtcacttcacgaagcatagcacgaatttgcaacttactttcagaactcaaacgcccgtcggatacctgattcagataattagcgatctccacctccatgttatcgcttatattctcatatttctcaatacgactgaacaatttgttaaagtcattgtcattagtggtgtgaagcaggtcccgcaccatgccaaacatacgatgagtacgctctgcaaagagattgatttccttgcgtgcctgcaatatagaaagctctgccgtagaaagcataccacctgtaataaagcgcaaacgatattcctcatcctgctctctctgaggaatgattttacagacagttttctctatcaacttgacaaaccaaataagaatcaacacattgcatatattaaaagtagtatgaaaagcagacagtttaaaagatacggcaacagccggatctgctgttctcattatatcttctacaaaccatgaaacccccatagttacaggcttgaaaaggcataacacccaaataaccccaaaaacattgaacaccaaatgagccagcgcagccctcctggcctgcgtattggcagtcagtgcggcaaggttagcggttatagtggtaccaatattctcgccaagtaccaacgcagcccccagctcaaaactaatccaaccattggcacacataatcaaagtaatagccatcgttgcagccgatgcctgtacaatcatggtaagaactgtaccgatgacaacaaataagataacagaaccaaatcccatatcagtatagttctgaacaaaagacaacatttcggggtttctacttaagtcaggagcattcgtcttcaagagagagaggcccataaacaaaaaagagaaaccgaatataaattctccaatggatttacggttactctttcctgaaaataataagggtacgccaacagccaataacggaagtgccatagcagcaatatctactttaaaccctaacgcagatataatccatgcagtgacagtggtaccgatatttgcccccataatgactccaattgattgtgaaagtgtaaggagtccggcattaacgaaacttactaccataacagtagtagcagaagaggattgaattaacgcagtgataagaacaccggttagcactccggttacccggttggtggtcatcgctgtgaggattttacgcagtctgtcaccagcaaacttttgcagcccctcactcatgattttcattccataaaggaatagcgccagtgaacctagcagctttaagaaatcataaaaagaatactccatctttaattaatttggtaggaattggctaatctcccttttattcagtaaatttcaagccgtttcactacgttagtaataattattacgattatgttacaaatctgttgcaaaaataacaatatttcaaagaacttcccaatcggaagctcacttttggatatttataatggttttaatctagatatcccatacgggccggtcagtgccaaagtcaataacaaagtagaaggactcaattaccgggcctataataataaggatgtagagttcctgaacatactgaatccttcaggaatgcgtacctatgtccgttctctctgcttcatcttgtgcaaagcggtggaggacttataccctgatggaaaaatcatgcttgaacatcccgtatccaaaggatattattgcgccttgcagataggacgcgaaaccgggctggatgatgtttcccgtattaagcagcgaatgaaagagattgtggaagccaacatccctttccaccgttttgaatgtcacacaactgaagtagtagaactattccgccggaaaggaatgatggacaaagttagactgcttgaaacttcaggggaactttactcctattattatactttagaagataccattgactactactatggcagtctgttgcccagcaccggatatatccgcaaattcgacattgttaaatactatgacggcttgttgctgcgagtccccaaccgtcagaatccggaaatattggaggaagtagtaaaacaagaaaaaatgctggaagtattcaaagagcaccgacgctggaatcagattttaggtgtgggtactgtaggagatttcaatgtggcctgtaatgaaggttatgccaccgatctgattaatgtgtctgaagccttgcaggaaaaaaaaatttccaatattgctgatgagatataccacagaggaaaaaacggtcaaagagtaaaactggttcttatctccggtccatcctcttctggtaaaacgactttcagcaaacgactcagtatccagttgatggcaaacgggctgaaaccttaccccatctccctggacaattactttgttgaccgagaaaagacaccaaaagatgaaaaaggtgattatgattacgaatcattgtatgcattggatttggagttcttcaacaagcaattacaagatctgcttcatggaaaggaagtagagttaccacgtttcaacttcaccacaggaagaagggaatttaaaggtgacaaacttaagattgacgataacatgatattgattctcgaagggattcatgcacttaaccccgaattaacccctcatattcccgccgagaataaatataaaatatatgtatcggcattaaccactattctgctggacaatcataattatattccgactaccgacaaccgtttgttgcgccgtattatccgcgattacaaataccgtggctattccgcagaggaaacaatcagaagatggcccagcgtacgcgccggagaagaaaaatggatcttcccatatcaggaaaatgcagatgccatgttcaattctgccctgttgtttgaactagccattatgaaggattatgccattcctattctaaggaatgttcccaataacaaaccggaatattcagaagcataccgtttacgcaaattcttggaatatttcgcttcggtacaagataaagaattgcctcccacttctttactgagagagtttttaggaggaagcagtttccggtattaacctgttattaaacagtatataagttttgtttatgtgcaaaacaaacagtaatttcggccattattaaacaagtataagtgaatgcactccaaaggctatagaaaactgttcaactgcctgatgttctactactaagaacatttcttcttcaggagggtatgccaaaagccagcagactgtacattacaccaccataaagatggattaaatgacagcgtatcttacttttggcatacgtttctttctatttgatatcttattctcttgcacatcaattggtcggatccattaatccgcccttatggaaatctctatttatgaaccagtagaccttattataactcttatgaaaacaacaatcaacggtatgacagaccgtatccgacgcctacgtcaagaatcttttgatacacaaccttctttgtccatagaacgtgctctgatagaaaccgaattttacaaagaaaacgaaggaaagtatccaattcctattctaagagcactgaacttccttgaaatctgtaaacggaaaactatatacataggtgaagacgaactgattgtaggtgaacgtggaccacgccccaaagccgtatcgactttccctgaactgacctgtcacagcgtggaagaccttcatgtattgaacacccgcgaattgcagcgttacaccatcagccaggaagatatagacacctatgagcgcgaggtaattccttattggaaagggcgcacccaacgcgaacgcatcttcaatcacgttcccaaagaatggaaagaagcttacgaagtaggaatgttcactgaattcatggaacaacgagcccccggccatacttctctggacggaaaggtttatcaacatggcatgctggatttgaaagaacgtattgcacatgagttgaaaaatctggattttatgaatgatccagaagcaaccgacaaacaagaagaactgaccgccatgtccatctcctgtgatgccgctatcatttttgccgaacgccatgccgaactggccgaaaagatggctggacaagaaaccgatccgaaacgcaaagaggaactgaaaaaaatagcggaaatctgccgatgggttcctgcacatgccccccgtacttattgggaggccatacaaatgtactggtttgtccatctcggcaccattacagagctgaacggatgggacgccatgaatccaggacattttgaccagcacctcgctcctttctatgaaaaagacctggaagaaggaatactgacccgtgcagaggccaaagaactgatgtcatgtttctttatcaaagtaaataatcagacagccccacccaaagttggcatcaccgccaaagaaagcggtacctacaatgactttaccaatctgaatatcggtggcatcaaacgtgatggtagcaacggagtcagcgaagtatcctatatcatgctcgaaacagtagatgatcttcacctgttacaacccggaagcgccctgcacatcagtgtatgcaccccggagcgtttcctgcgcgaaggctgcaaagtaatccgtaagggctatggctacccatctgtattcaatcccgacacatacgtcatggaactgatgcgacagggaaaaacaccggaggacgctcgtgaaggcggatgtagcggatgcatagaagtaggcgctttcggaaaagaagcttacatactgaccggttaccttaacgtacccaagatattggaagtcaccttgcacaacggaacagatcctgtatcaggcaagaaagtaggcttggtaacaggagatccctgtaccttccggagttatgaagcactttatgacgcatttcttaaacaaatccattattttgtagatatgaaagtacgcgtcagcaactacattgaccgtatgttcgccaaatacgctcccgccactttcctgtctttgttcattgatgactgtatcgccaaaggaaaagattattataactgcggaccgcgttataacacaagctatattcaatgcaccggtttgggtactattaccgacagcctctccgttctgaaaaaacatgtattcgaagaacgtaaattcaatatggagcaaatcatccatgctaccgataccaacttcgaaggacaggaagccatgagacagttcatactgaaccgtacccctttcttcggtaacgatgacgaatatgcagaccgcatcgccatccagatctttaacgacctttacgatgccatcgagggaaagccgaacaccaaaggcgaatgtttccatctgaacatgttgtctaccacctgtcacgtttacttcggcaaaatgatgaatgccacccccaacggccgtctagccggacgtgccatcagtgacggtacctcaccctcacacggagcagatacccacgggccatccgccgttataaaatcattaggaaaactggaccaggtgaaaagcggaggcactctattgaatcagcgcttcctgccttcacttcttaaacacgatgaagacatagccaaactggtaagcctcatccgcagctattttgctttaggaggacatcacattcagttcaacatagtagataccgctaccctgcatgccgcccaaaaacatccggaagaataccgggacctattggtacgcgtagctggatacagtgattacttcaatgacatgaatacagatttacaatatgacgtaatagcccgcacggcacaagaaaccttctgacaagatgagtctgattttcgacatcaaacgctatgccatcaatgacggaccgggcatccgcatcacacttttcatgaaaggatgcccgctctcgtgcatatggtgccataatcccgaaggcattcgtaacggaaaagacaaactatacacagccaagaaatgcctcggctgtggaacttgtctgaaagcatgtcccaacggggcactgacactggctcccgagggtattatcaccgacaaacaaaaatgcgtgttatgcggacgctgtgccgaagaatgtccggcaatggctatcgagatatcaggaacggaatataccgccgaatacctgatgcatgaaatagaaaaggaaattccatttatggatcaatcgggcggtggagttactttttgtggtggagaaccgttgcttcatcccgaattcttgattgatatactgaaacgttgcggacaacagggaattcatcgggtggtagataccaccctgcttgcccgcaaagaaacagtggatgaagtgatgcggaattgtgaactattgcttatcgacttaaaatcaatggacagtaccgtacaccagacattttgtgatgttcccaatgaattaattttggagaacatccgcagagtagcagaagctgactttccttattatatccgtattccattgattgaaggagtgaatgcagatgaaaagaacataaagctgtctgccgaatttttggccagtcttccacggcatcctgagatcattaacctattaccttaccatgatataggaaagggaaagcatgcaaagctaggcagtatctataaccctaaaggatataaaatgcaaacgccatccgaggaagtacaacagcagtgcatacaaatcttgactgattacggtttaaaagcaaccataggtggataattatatatcatcgttctgtagtaaaaggaccttcgtaccccaaaaacgtgccccgtcctccgttatcaaataatcttcctcattacgcaactctgtaaactcacgataactctccaacttatcataatcgataaaatccttaaagcatttctccgctttccaacaatctattaatatagatacccggttctatagtaagttcaaattccggttccaaagatccgaccagccttaataatttacggctgacctaagtacttttctaatgaatcacctgtcttttagcaactgctttttccaaacacttcttcaaatccgcggcagaaccagtttctgtcactcccaccctctacgctttctcacacaaggcaggctggatcccatccatacaatatgatatccatatcgccaatccggcatagggcaagtcccaaaaataaagagaagtagaaccttggcggaaatgataagtattatccgcatagtcgccactctccccgttatctaaaatagcaagaaacctatccccacgttttttcaaactgttacgacgggttgtataagtttcttttgcaaacataatcttatgttttttatatagatgacaggtaaagatagccatccccttaaaataatccccccaaaaaggaagattattacaatacaatttcctatttttgtcgcaataaacaaggaaataaaaatattatggcacaaggctcacgtcaagtacaaacacaagcccagcaacaaatacaaaccttatctccacaacagatactggtagtgaaattgctggaactgcccactgtggagctggaagaacgtatccattccgaaatactggataatccggccctggaggaagggaaagaaatgcccgaaaatgaagatgacaacacagaatacgttgagaacgaagacggaaatacagactcgaacgaagatttttcattaggcgattacagcaacgaagatgatattcccgattataaactacaggaacataatcgttccaaagaaggagtagccgaagaaatccctttctcggatgccgtatctttttatgaaatattgaaagaccagttgcagatgcaggaacttaccccagaacaacgagatatagcagaatacttgatcggttcattggacgatgacggcctgttacgcaaaaatatggagtctatcatggatgaacttgccatctatcgaggcatctataccactgaggaggaattaaataaaatcttggaaataatccaagactttgatccggcaggtatcggtgcccgcagtttacaagaatgtcttctgctacaaatacaaagaaaagccgattcaccgttaaaacaaatagaactggacatcatcggtaaatgctgtgatgagtttacccgcaaaaacaaagaaaggattatccaaaaactaggtattaccgaagaacaatataatgaggcggtgagcgatctcaccaaactgaatcctcgtccgggcagttcactgggtgaagcaatgggcaaaaatatgcagcagatcattcccgacttcattgtagaaacgtatgaggatgacaccattactctaagtttaaacaatcgtaatgttcctgagttgcgtctgagccgccagttcaccgaactactggatgaacacacccgcaacaaagataatcagagcaaagcctcaaaggacgcactgatgttcctaaaacaaaaagtagatgccgcacaaggttttatcaacgccgtaaaacagcgacaacatacgttgctcaccaccatgcaagccattatagatattcagcgccccttctttttggaaggagacgaatccctgctaaagcccatgatcctaaaagatgtagccgaacgctcgggattggatatttccaccatatcacgggtaagcaacagcaaatatgtacaaacaaactatggtatctattcgttgaaattctttttcagcgacggttacactaccgaagacggtgaagaactctcagtccgcgaaatcaagcgtattctgaaagaatgtgtagacaccgaagacaaggaaaaaccgtacactgatgatgaactggccgaaacactaaaaacgaaaggctaccccatagcccgccgtactgtagccaaataccgccaacagcttaacatacccgtcgcacgattaagaaggtaatataaattatatggaagctaacgaaataaccgaaacaatagcagtaggcaagaaaaacagtccgcttgaagtcagttcacgtatcatatcaggcatattcacgccttttatgattccttttgtggcatttttcctgctttttttcttcacttatcttcgtatcatgcccatccagtacaaactgatagtattgggcatagtctactgtttcaccattctgatgccgatgctcgccatctacctgttccaaaaaataaacggttggggtattcatgaattgggacaccgcgaaaaacgtttcgtaccatatgcgttgactatcatcagctatgtcacttgtctcatcaccatgtataagatacacctgccccgctatatgtcaggtattatcgtagccgccctcatctgcatgatcctttgcacgctgatcaatttcaagtggaaaatcagcacacacgtggcaagcagcggcatgatggtaggcggattattatcctacagctttatattcaatttcaatcctgtatggtggctctgttttttcattttgctatccgggatgcttggcacagcccgtatcattgtaaaacagcataccttattagaagttttagccggatttattgtcggattgttttgtggtgtcattggaattttgtttatttgaaaaaaattagtattaaccttataaattgaaagcattatggaatttccaagcaatgtaaagtataccaaagaacacgaatggatacgagtagaaggtgatatagcttatgtaggcatcactgattatgcacaagagcaactgggtgacatcgtattcgtagatatcacaactgaaggagaaactttagaaaaagatgaagttttcggtactattgaagtagtaaaaacgatttcggacttgttccttcccgtttcaggagaagttttggaacagaatgaagcattggccgacaatcccgaattagtaaaccaagacccgtatggtaaagggtggctgattaagattaagcccaatgactctaatgacgttaacgatttgctggatgctgaaggatataaagcattagtcaacgaataatatagattcccattaggaattgttcaagcgcggattacgcggacctcacggatttttctatccgcgttcatccgtataacccgtgcttgaagtaaatatataaaccaaacaataacaaaaaacaatgaaacctatcgtaagcattatcatgggtagcacttccgatcttcccgtaatggaaaaagctgccaaattactggacgagatgcacgtacctttcgaaatgaacgccctttcggcacaccgcactcccgaagctgtggaggaatttgcgaaaaatgctgcaggccgtggaattaaagtcatcattgccgctgccggcatggctgccgcacttcccggtgtcattgctgcaaataccacattgcctgttatcggtgtccccgttaaaggttctgttcttgatggcgtagacgcactttattctatcatccaaatgcctcccggaattcctgtagctactgtagcaatcaatggagccatgaatgcagctattctggccgtacaaatgctagcattgagtgatacagaactagccaccaagtttgcagactacaagaccggcttgaaaaagaaaatcgtgaaagccaacgaagaactgaaagaagtcaagtttgaatataaaacaaattaactagtggttagtgattagtggtaagtggttaatatttcagcgcagcccactaatcactaaccactcaccactaatcactaactatggatttattcaattactcccgccgcgaatcttccgaagtgaatatcggagccactcccttgggtggcaacaaccccatccgtattcagagcatgacaaataccgtcactatggataccgaagcctgtgtggaacaagccaaacgcattatagatgccggcggtgaatacgttcgcctcaccacacaaggtgtccgtgaagccgaaaacttgaagaatatcaatatcggattacgctctcaaggatatgatactccattggtggccgatgtacattttaaccccaaagtagccgatgtagcggcacaatatgcagaaaaggtacgcatcaatccgggaaattacgtagacccgggacgtactttccggaaactggaatacactgacgaagaatatgcgcaagaaatagaaaagatacgtgcccgcttcattccttttctaaatatctgcaaggaaaaccacaccgccatccgcatcggggtaaaccacggttctctgtcagaccgcatcatgtctcattatggtgacacccctgaaggtatggtggaatcgtgcatggaatttctgcgtatctgtgttgcggaacatttcaacgatgtggttatttccatcaaagcatccaataccgtagtaatggtcaggacggtccgtctgctggtaaaggaaatggaaaaggaaggcatggctttcccgcttcatttgggggttaccgaagcaggggacggcgaggacggaagaataaaatccgcattaggaataggcgcactccttgcagatggcttgggagataccattcgtgtttcattgagcgaggctcctgaaaacgaaattccggtagcccgcaaactggttgattatatactaactcgggaaggacatccttttattcctggaaaagaagctccgcagttcaactacctatctccggggcgccggaagactaaggctgtccgaaacattggaggagataatcttcccgtagtaatagccgaacgtctgaaagggtctttcgaaactaatcctcagttcaaacctgactatatttattgcggtggaagtgtgccccaatcacgagataacaatatagcctatctagtagatgccaatgcatggaatccagaagaaaaaaatgtctatccggcatttaactaccagcagatgatagaattacatcacacggtttccgatctgaaattcctgtttctgccctatatggctatgaatgacgaagtaatcgcagcccttaaactacatcccgaagtggtaatcatcgcccaaagcaatcatcccaaccgcctcggcgaatatcgtgccatgacacacgaactgatgaatgaagggttagagaatccggtcgtattcttccaatactatcaggaaacgaaagctgaagacctgcaaatcaaagcggcagctgatatgggtgcactaatttttgacggactctgtgacggaatcttcttgtacaaccaaggccccttgagtcatatagtggtagataccactgcatttggtatcctgcaagccggcagaatccgaaccagcaaaacggaatacatttcatgtccgggatgtggtcgtaccttatatgatttggagtctaccatcgcccgtatcaaaacagctacctcgcacttgaaaggtctgaagatcggcattatgggctgtattgtcaatggtcccggcgaaatggcggatgccgactatggctatgtaggtgccggtcgtggaaaaatcagcctctataaaaagaaagaatgcatagaaaaaaacattcccgaagatcaggctgttgagaagttgatcgagctcatcaaagccaatggtgactatacagaaaaataaaaacgtccaaattatggattatcaacagattctaaaagacatctatcaagaaatccagccctacgcctctattggcaaacaggctgattacattccggcacttgccaaaatcaacccagatcaattcggaatgtgtatccatacgatacaaaacaaaactttcatgcatggagaagccaccaccggcttctccatccaaagtatttcgaaagttttttcacttgccatgtgtttgagtcttgaaggagataatctatggaaaagagtaggtaaagaaccttcgggaacagctttcaactcactagtacaactggaggtagaaaaaggaattcctcggaatccctttattaacgccggagccattgtaatgacagatatcctgctgaaccatctgaaacaccccgaagaagaatatcttcgtttcgtccgctcaatcagcggaaataaccaaattcattataatgaagaagttgccctgtccgaacgtgaaaacggttatctgaatgcggcaatcaccaacctgttgaaatattatcataacatcgacaatgacatagaacgtgtacttcatttctatttcctgcaatgctccatagaaatgagttgttatgatttatccaaagcctttttgccgtttgccaaccataaacaggcttttacattcgaaggaatcacgctgaccgcctctcaagtgaaacgtatcaatgccatcatgcaaacatgtggattctatgacgaagcaggagaattttcttatttggtaggtcttccggggaaaagtggtgtgggaggcggtatagccgcagtttacccactacgatattcagttgcagtgtggagcccgagattgaatccaaaaggaaattccgttatgggaatcaaggcgctggaactattgacaacacagacacaggaatctattttctagaaaacaagcatctctccatactaaatcatcttctttcttgttggaataatccagaatgaagttgaatataacacgcataatacttatagcctttctataaaagagagaagtacctggaatttatgtagaaattattgaccatgcttaataaattaaccgtttttaccctcaatggaacatcttctgtttgccataaataaaagaaataaccgacagccaaagtcttttgaagatatcctgaacaggcacttaaaaacctgcctcagcatttcaaatgtccaagacaggttcccttatattttatagagatacagatcaatatctgtttctgccaccgccatagccattatctccgcgactaccaccatagccaccaccacgactgttgttaccgccacgataaccaccaccgccattgttgccatagctacgacgcggacgttcttctctaggacgagctactgacacagaaagagtttttccatccatatcaacttcattaagagctgcaatcgctttatctccagcttcatcatcagccatttcaacaaaaccatatcccttagaacgaccggtctctctgtccattataatcttaacagaaacaacttcaccatactctgcaaataattctccaagttcggcttcactcatattatagttaagccctgcaataaaaatgttcattttaaaataaatgttttaataaaaaaataagtgcgttttgctattaggaatcttacagagagacaaacgattctaccatcatcactaaagaataagttggaaaagtattaatgtacttctatgaggatacttaatgcaggggacaaatgtacgcaattagacttgaactcaaaactaattggagatttatttttaataataaatgttttttcgttctctttgaaagaacagacaagttttagaacggaaataactgtttctcaaatacatatttatactttaaaagctattatacagaaagttatcctgtactacatatcaaaaagataaccaatctccagccagatcagcattctttatagcaacaggccagatactttccgtagaaggaattattatggaagaaatttcagaaacaggaactacagaaaattcttcagtttccaaacaagctgcgagaaaccgcaaagtaataaaatacagaaagagaacttatctttttcatcttcccaaccataattccggattaagtttagccgtttccttacgaagttggaaatgcaagaccgtattacccgaactatctgtatggatagtaccaagaacggtacgtgtattgactttgctgcctttagaaaccgatacggaagaaaggttgcaatagacagagatgtaattaccatgacgcaccagtatattgttcaaaccattatactggaaaatagccgaaacttctccattgaaaacggcacgtgcctgcgctcccggtttgcccttaatatcaatccctttattatccagtttcacattacgcaaaccatctacggcatactgtccgtaatggctgacaatcacgtatggaccggtaatgggaaccggcaaaataccccggttacgttcaaaactgcccgacagctggcggtcctcattattcagactgaacttctccaccggagcgaccttctttgtagactcatttttttccgtagatttagaacgggacgcccctcccgtagtttcacgctccgctttcttagctgctgccgcctttgcggcagcctcagcagcggctttcctacgagcttcctcctctgcacgctttctagctttctctatttcaatttcaatcaaacggtcaatctgggcattcaattgctcagccgaacgttttttcttccttatctcgctttgtatacctttctgcttcttttgcaaattcgccaaaagagtctggcgctccttttcctgaatctccagtttggccttttcgacctcaccctgttttaaaagattctgtttggcatgcttagtttgttccacttctctttttttagcggcaatttgcttctgcttacgttctatctccattccttgaaggcgctggaagtttgcatattcctgcacataacgcatacgacggtaagtctgactcaaattctcggcagaaaaaataaacattaatttctcttgaacagacttgttacgatacatgtattgcaccgaagtttcatacttccgcttcttgtctttcaaatcacgctgaagtttattcagttgtttctgtaaagaagcgatctcacttgtcaatgtatgaacatcactctctatggtactgatatattttcttctctcctcaatctgacctgtcagcaaagcaaggttgtccaactggcttttcacatcctttttggtagattgcaacaaagtttcagactcggcaatctgctggtgaagttccttccgtttggcttcaagctcccttattttccgagtactttgcgctgaaatagtacttaaaaagcagcaggctatgagtagtaagaagatacgtttcattatttaataagctgttttagcaaatcttgcaattctattctttcgtattttccgggcacttcggtatgggcttcccaatccttattggtagaaaggcgggaaagttcaaatacagccgtaaccggtttggcagccccttcaaaagaaaccgtcatagttcccggaaactgtttctgctccaacggacgaaacttatcataacgccaatttatcccgtaccgggtaccggacaagccgatatgactttctttcagcagcccatcatttgtattggtacgaaaacggtaggcgaaatgtttgccgttcttaacttctattaatgcattttcgttttcaggacgcacagcaaaggacgaaatatcacggacagtcagcaccttttttcccggaagaaaaatttcattcataaacaaggcctgcaaagtatgaaaatccaaatcagcctttgccagattcttcaattcatcaaaaggaacttgtacataacgtttgttcatgcgatccatcactaaaactccgtccggagatatttcagcacgtgccacttcaatacccaaaaatggagcgatagaaagctggattacttcatcacgtttcatgcgcaacgtaccatttactttagtcggtcctttaccgttcaagtcaacggccaatgacattttcgcagtaattgcatcccatcccggagaacggctaatcagctcttccatatattccgactcggataaattgccaatagatacccctttcttcatactccgggtagatgaacatgaagaaataaatataatcagcaaagcgctaaacaaataaaaacagacacgtttcatcattctgcaaagtatttcttttgtacaattttctttctcaataagttcaattccttctcactacgttcttcactaccttcttgaggaggctccttggataatttttccgcttgttgccaatattccaaagccttttcacgatctccattcatatagtaaatatctccacaatgctctacaacaacggaacttttacttccatcattctgcatagcctggtcaatgtaaatttttgcttctacatatttacctttctcaaaaagtatccaggcataggtatccagatacgtaccattggtaggttcggcctttacggtacggtaactcatttcttccgctttatccaggtttttacgctctacagacaggtaataggcataattattcaaggcccctatattgttttccttataaaccaaagcggaatcgtatgcggcatatgcctccacattcatcttctttatatgataaagatcccccataatggcatagaaatcagaaacgatatccttattgcttttatctgttacttgattcactccttttttaaaaacctccaatgcctcgtctgttttctctttctgatgataggccaatcccatataataatagaattccaatacatccggagtatattctaaagcaggagcacacaatttgattacttcatccatattctgctcacgaatggcaaaactcaatagctgcaagcgtgccggcgtattttccggatcaatttcaagcacttggtgcaaaacaggggttgcctctttatccatctttttcgtcagaagatattgggccgccaacatagcaatatctgcattctcttgtttttccttcaatatagaagtaaacaggcctgctattttcgtactgtccttgttcgtttgctcggaacgcagaataagctggcgcataatgttcatctttgtatcgctatccacattatcattcagcaaaatagtatccaactgtacctgatacaaactatcctgcccttttttctcgtaataagaagccatggaaagcaacgccggcgcatagcccggttcttccttcaatactttctgataagtttcgtatgcttcttcttccttaccgttgttcagatagacatctcccaaaatggtaagataacgcatgtcatatggatattcttttgccaaattctcaatctccgtaaatgcctgctggtcattgttcatggccagatacatacggaatttttccatgctgatttgttcagacttcccatccaaggcttcaaggcggttcaatgtattaactacctgctgatagtccttggtacgggtatagagatcaatcaaagccatcaacggttccagacgtgaggggaactggctcgccatatcctcataaacataaatggctttcgggtaatttcccttaccttgataataggctgccaaagtttgcttataccaaaaactcttaggatcggcatccactgccttcttcaaagcttcctcccctttttccggctgattgagaaacatatggaagcgggaaatttcgaacaaagtagcggctccttgcggataaatgtccaaacagtgactatacatttcgaaagccgcatccaagtcacctttttccttcatccgaagcgcttccaaaaagaaatagtcgtatttacggcgctgctccggagtaagcggatccttttcctccacaacagctttatttccggacaagccggaagctctcttcaccgtaccgcatgaaacaagcatgcctatcagacatacacatagcatgggcacatatttcaatcttctattcattgtttccttttacttttttccggtatgtccaaagccacctgcaccacgttccgtttcgtccagcacctccacttcctgccattcggcatgttcgtgacgggctacaaccatttgcgcaatgcgctccccatcttctatcataaaatcctcagatgacaaattgaccaggataatacaaatttcaccacgataatcggcatcaattgtgcccggagaattcaggactccgatgcctttcttaatagccagcccgctacgtggacggatttgcgcttcaaaaccttcaggcaatgcgatataaagtcccgtaggaaccaaacaacgttgcaagggtttcagcacaatcggttcgtcaagattagcacggatatccatccctgccgattgcccggtagcatactcgggtaaagcatgttttgatttattgattacctgtattttcataattttaataatttatcaatatgcttatatggcaatgtgctaataatttgcagacaacaaacacagtccagacatgatacagcccattggcatattgacgaatcaacacattgccacatgattaataaggtgcgaatttacacatttagatggatttatctaagcgtttacagttttttaaacggaagtttcttacttttgcaaacagataaagcctgaattatgaactggaaacaattaatatcaaataaacgcttcggcatggaagaactacacgaggcccgtaaagatgaccgtaccgaattccaacgcgattatgaccgtctcatcttctcagcacctttccgtcgtttgcaaaacaaaactcaagtatttcctttaccgggtagcgtatttgtacacaaccggttgactcacagccttgaggtctcttgtgtggggcgttctttaggaaacgatgtcgccagccagcttctgaagaagcacccagccttggccgactcccatatctcggaaataggttccatcgtttcagccgcatgtctggcacacgatctgggaaatcctcctttcggtcattcgggagaaaaagccatttcaacttacttctcggaaggacaaggaatggcattgaaaaaagaactttcaccgatggaatgggatgatttaacccacttcgaaggaaatgccaatgcattccgcatcctcacccaccagtttgaaggaagacggaaaggagggttcgtgatgacctactccacactggcatccatcgtaaaataccctttttcctcacaattggcaggaaagaaatcaaaattcggcttcttcttaagcgaagaggctgattatcagaaaatagccggagaattagggattatccggctcagcaaaccggatgagcctttacgctacgcacgccatccgttggtctacctggtagaagccgcagatgatatttgttatcagatgatggacatagaagacgcacataaattaaaactgctgacacatgatgaaaccaaaggactgtatatgcagttctttgatgagaaaagaagaaaacgcattgaagaagtttgccggattgtaacagacgtcaatgaacagatagcttatttacgttcttcggtcataggcgcactgataaaggaatgcacacgagtatttactgaaaatgaagaaaagatattgaccggggaatttgaaggcaccctgataatgcacatttgcagtccattgaaagaggcctatgacaattgttctgcaattgcctttcaaagaatatatcgttccagcgatgtgctggacatagaattggcaggattcagggttatcagtaccttgattgacctgatgattaatgcagtgcgctctccggaaaaagcgtattcacaactacttatcaaccgcatatccggacagtacaatgtcaacgcacctactttatatggaaaaattcaagccgtgctggattacatatcgggcatgacagacgtatatgcgctcgacctctaccggaaaatcaaaggcaacagtctgccggcagtataataaaaacattgtcagatgcgagcaagatgaatcctgtaaattttatctgcacctgacaatgtttccccaaatactactattagtccgattatttggtcagtatgggatgagcgcctgaagttattttcatagcttcaggatgttgctttacaaacgattcgatatgacgtacccgtttgtcttccagaatttcattgactgcaatcagaattccggtttcctccacatctccgaatccataattaatcgctgttccaaacatacgcattgtaggagacagactcatatatgcattgaccaaaggaggaatattataccccagcttacgcacttccgtattcaagatcttgtaatcttctttaaaggaatcataacagaaaagattttccaacattttcttatctgtttctatttccagcggtttcatcggagttatcaatttatctttatcaccgaaatgtttattcaggaagtataatatcatgtcacgcccctgacgatgataactaggatacatagtcatcttaccaaaaaaatatttcacattaggcttaatcacggttaatgcgcccaaaccatcccacaaattatccaaagcaaacaatcccttggaaccggcacgggttgactgatattccaatgtaacaaatgagcgtcccaactccaccgtgtaaggcaaatattctttcaaaaaaacttccgagaaattaaacatgtgagcagtagccagcacaggcttcccatgttcatcaaattgcacctcatcccccaaaagataacgataacctcccaaaatctcctccgcttcaggattccatacaactaattgcttatatggattttccatcacgtcatattcatcgatatccatcgcctttcctgttccgccacctgcagcacgaaaggctatttctctcaaccggccaatctccttcatcacattgggcgaatcctgatacgttatgacgtaaatttcattatgacttttattcgtaaacctcaggcgtttatcctcggaaagttccgccttcagaatctctttgctaatcggtgcaataatttcttccatatcttttttctctcttttgtctattatagcttgtagactacatcttttacaaactgcgcccactgagccggggtctttgtcttgtcgaaagtttgccaaggaatgggttttccaatggtcaaggtaaaggttttatgacgatttttcaacatttcatctgccaagtaaagcatagcaatattaaacttaatgccaagtgccttacatatatttgccaaattataaaaaaagtctgagttccggccctcaaagtgcaaaggtaccacatcacgatgcgtttcaatacttttagtgacaaatgtctttttccattccaaatccttgatttccccaccctgtctacgggaacataaccccgcaggaaacataatgatatgattatccgaggcaaaccctgcctctaccatcttcgggaaatccctggattgcgagcctgttttattgataggaatacataaaggagccaaaccatgcaaattcatcaacaaatcattgaccaaatagcgtacattaccattgtaatgttttcccaatatataccccaaagcaactccatcctgtccccccagcgggtgattgctgacaaaagtgcatttaccgttttcaggcaagttttccaaaccttttatctccacttttgcatccaggaactccatacaagcttccagaaagtcaactccgactttatttttggagtcttttaaaaagacattcagttcatcctgatgcacgatatgcttcaggtacgaaacgacaaaacggggaatatatttatattttttcccggctttcgttttcaatatcttttctatgtcgattaaaaatatagagtcgtcagtcattttgcaaacgttcttttccatgcaaaagtaacttatctttttttatattggcaatttatgacagaaaaaactcttaatctctaaagaaattaagagtttttgtgtatgaaactatacaaattctttcatttttgcgcaaaacaaaaacgaatgtgcaatagtttggtttcgtttttcaacctccgagaagctgccctttccattattttttatcataaaattattaattttaaacctcctgtttaccaagctactagctacattaacagcctgttgaaaacttctcgaaatattttcttaaaatattgtggggaattgtggggaattgtgtaattttacaccttgaacaatataataaggtgtaaacatgcgatttcttgggaattctgaagcaaagacggatgcaaaaggcagagtgttcctgcctgccgtattcaggaagcagctacaagctgcctcccaggagtgcctgattttacgcaaagacacctaccaagactgcctggtactttaccctgaaaatgtgtggaacgaacaaatgaacgaactacgttgcaaactcaatcgctggaattccagacaccaaatgattttccgtcagttcgtttcggatgtagaagttatcacattggatggaaacgggcgctttctgattccaaaacgatatttgaaattagctaaaatacagcaagatgtacgttttatcggattggacgacactatagaaatctggtctaaagaaatagcagacaaacccttcatcacaccggaggactttggaaaagaattggaagaaattatgggaactaataacaacgtagaaatagaatgagtgaagcaaaacagatatatcatgtaccggtattattaaacgagagcgtagacggaatgaacatccaacccggaggtatttatgtagatgccactttcggcggcggaggacattccaaggaaattctaagccggctgggtagcaccgcgcatctatatagttttgaccaagatgaagatgccgagaagaatattgtaagcgacagccgcttcacttttgtgcgtagtaacttccgctaccttcccaacttcctacgttattatggcgtggaaggggtggatgccattttggccgatctgggcgtttcctcacatcactttgacgactccgaacgtggattctcattccgcttcgagggcaaattagacatgcggatgaacaaacgcgcaggtatgacagctgctgatgtagtgaacacctatgacgaagaacgtttggctaatattttctatttatatggtgaattgaagaacagccgcaaactggcatcagccatcgttaaagcacgaggtgtaaaacaaattgtcaccatcggtgatttcctcgaagtcatcaaaccgcttttcgggcgggaacgtgaaaagaaagagctcgcaaaggtgttccaagctttacgcatagaggtaaatcaggaaatggaagcattgaaagaaatgctttatgcagcaaccaaggcactgaaaccgggaggcagactggtagtaatcacctatcactctttagaagaccgcatggtaaagaatatcatgaaaaccggaaacatagaaggcaaggccgaacaagatttctttggtaatgtacagacacctttcaaactagtcaacaacaaagttattgttgccggcaacgaagaagtgacacgcaatccgcgctcccgaagcgccaagttgagaattgcagaaaagagataacgagatggaagaagaactgaaacaaaatacacaacaacccaaagacggacaatctgcttcgcccaagcatatgtctatccgcagcatattaggaggagatatccttgcgaacgactttttcaaaagacagacccgtttgctgattctcatcatgatcctgactgtactatacatagacaaccgttatagcagccaacaggaactcattgaaattgacaagttgaaaaaagatttgatcgatatcaaatacgatgcattgacacgctcttccgaactgatggaaaagagccgccagtcacgtattgaagaatatatttcgacggaagacagccccttgcaaacggctaccaaccgtccttatttaataaagaaagactaagcccatgatgcccaaccaaaaaaacataatgctccgcttctccttcatcatcctggtcatggtgttgataggcattgccattatctgcaaagccggcgtcatcatgtttgccgagcgtcaatactggaaagacgtagccgaccgttttgtaaaagaaaacgtcaccgtacgtcctacccgtggcaacatcatctcatccgacggccagctgatggcaagcagccttcccgaatataagatttacatggacttcatgataaataaaaggaagggcgaaaccgaagaagaggaaaagaaacggctgaagctacaacatatcaaagactcagttctttatgcaaaccttgacacaatctgcaaagggttacatgaaatattccctgataaaagtgccgcctttttcaaacagcacatcaaaaacggaagaaaaaaagagagccgcagttggttgctctaccccaaacgcatttcttatatacaatataaagaagcaaaacgtctgcccgtatttaacctgaacaaatacaaaggcggattccatgaacaggcattcaatcaacggaaaaaaccttttggttcactggcaatgcgtacattaggagatatgtatccagatatagaacaaggtgcaaagaacgggttggaactttcatacgattccatattaaaaggcagaaacggtatcactcaccgtcaaaaggtaatgaacaaatacctgaacattgtagatattcctcctgtagatggctgtgatatcattacgaccattgatgtaggtatgcaagacatcgcagaaaaagcattggtggatgaattgaaagaaatcaacgctactgtaggcgttgccattctgatggaagtgcagacgggagacatcaaagctatcgtcaacatgaccaaatgcaatgacggcatttacagagaaatacgcaataacgccatctcagacatgatggagccaggctctactttcaaaaccgcatccatactggtagcgctggacgacggagtcatcactccggaaacggtggtggaaaccggtaacggggtctatatgatgcacggccgctatatgaaagatcataactggcatcgtggaggctacggcactatcaacacaacaaaatcattgatggtgtcctcaaacatcggtgtatcacggttgatcgatgatcattatcatgataatccggaaaagtttgtacgcggactgcatcgagtaggcattgccactccgttagatctcgatattcccggtgccggcaagccgaacatccgcatccccaacaaagacttgagcaattggtcacgtactgcactggcatggatgtctattggctatgaaacccaaattccccccatcaatacactggcattttataatgctatagccaataacggagtaatggtcaagccccgttttgtgaaatcaatagtcaaagacgggcaggtagtggaagatattgctcctgaaatactcaacccggccatcgcttcccccaaggctatcagcgagatacaaacgattttggaaaaagtcgtcagcgaaggactgggaaagaaagcaggatccaagcaattccatgtatccgggaaaaccggtactgcacaggtttcacaagggaaagccgggtacacgaatggcacacgccgttatttggtaagtttctgtggatattttccttcagaagcgcctaaatacagttgcattgtagccatccagaaacctggactccccgcctcgggtggtctgatggccggcagcgtgttcagtaaaattgctgaacgcgtatttgccaaacatctggcacaagatttgaaagaggcaaaagactcaacttctatccttattccggatgtaaaaaacggggatataagtgcggcacattatgtactgaaccggataaatgtaaattcatccggagtttcggaacaatcaaccgaaggcaaaccggtatggggaaatgtgactagtaatccggacaatgtattattcaacaaaaaagacattaacaataaacttgtaccaagtgttattggtatgggcgcaaaggatgctgtctatctgcttgaaagcatgggattgaaagcccgcattaccggcatcggtaaagtgaagtcacaaagtatcccggccggcaacactttgcgcaaaggacaaaccatacaattacgattaaattaacagtgtaacaggaagaatatgaaactggaaaagattattaaaggaataacagtcaatgaaatcataggtgatgcatcccaagaaatttcgggaataaacatggactcgcgcctgatagagcccggtcatattttcgttgctgtaaaaggaacgcagactgacggacacacttatattcaaaaagcaatagaaaaaggagcccgtacagtggtatgtgagaatcttcctgagacattgattgagaatgttacctacatcaaagtgaacgatacggaagacgttgtcgggaaactggcaactacgttttacggcgaccccacctcgaaattggaactggtcggtgttacaggcaccaacggaaaaacgactattgccaccttattatataatatgttccgtaaattcggatataagacaggactcatttccactgtatgcaattatatagatgaggaagccattccaactgaccataccacccctgaccctattacactaaacaaactgctggggcgcatggcagatgaaggatgcaaatatgcctttatggaagtaagctcacattctgtagcacaaaaacggatcggtggtttaaaattcgcaggcggtatatttaccaaccttacccgtgaccatctggactaccataaaactgtagagaactatctgaaagccaaaaaagcattctttgacggtttgcctaaaacagcctttgccttaaccaatctggatgacaaaaacggattggtcatgactcaaaataccaaagcaaaggtacacacctattcgttgcgcagcttgagtgattttaaaggaaaagtactggaagatggattcgaaggaatgctgcttgatataaataatgtggaagtcaatgtacagttcatcggacgtttcaatgcttccaacctgctggcagtctatggagcagcctgcctgcttgggaaaaagacagaagaggtattgctggcattgagtactcttcgccccgttgccgggcgttttgactcactgcgctcacccaagggatacaccgccattgtggactatgcccatactccggatgccttggaaaatgtgctgaatgccattcacgaggtcctgaatggcaaaggtcatgtaattacggtagtaggcgccggcggcaaccgcgataaaggcaaacgccccttgatggcacaagaagcggtaaagcaaagcgataaagtcattatcacctctgacaatccccgttttgaagagccgcaggaaatcatcaatgatatgctggcagggctgactaaagaggatatgcgtaaagtgataagcatagccgaccgtaaagaagcgatccgtacagcttgtatgctggcccaagctaaagatgtcattttagttgccgggaaaggacacgaaaattatcaggaaatcaaaggtataaagcaccatttcgacgataaagaagtattaagagatatttttgctaatgaataaaccaaccaaaagatgttatattatttatttcaatatttagaaaagttcgattttcccggagccggtatgttcggttacgtttcattccgttcattgatggcaatcattttatcattgttgatctcagctatcttcggtgaatatttcatcaacctgctcaaacgtaaacaaataaccgaaacccaacgtgacgcatctatagacccttttaatgtgaaaaaagttggtgtgccgacgatgggaggtataattattattgtcgcaattctcataccttgccttttgttggggaagctgcataatatttacatgatattaatgttgattaccaccatttggctgggtacgttaggctttttggacgactatatcaaggtcttccgtaaagacaaagaagggttgcacggcaaattcaagatcatcggccaagtaggtttgggactcattgtgggactcaccttatatttaagtccgagcgtggttatccgtgagaacgtagaaatacaaagaggaggagaaattgtggaagtggtgcacaaggaacaagatcagaagtccaccaaaactacgattcctttcttcaagaacaacaatttggattatgctgatttcgtaggttttctgggagacaatgcccaggctgtaggttggattattttcgtattagttaccatcttcgtagttactgccgtatctaacggtgccaacctgaatgacgggatggacgggatggcagccggaaattctgctatcatcggtcttaccttgggcatattggcatacgtatccagccacatcgaatatgcaggataccttaatatcatgtacattcccggcagtgaagaactggtaatctttatctgctccttcatcggcgcactgatcggtttcctttggtacaatgcttttcccgcccaagtatttatgggcgataccggcagcttgaccattggtggtatcatagcggtatttgcaatcatcattcataaagagttgcttatacctattctctgtggaatcttcttggtagaaaacctttcggtcattctacaggtgagatatttcaaaagcggaaaaaagaaaggacatttgcaacgcgtattcaaacgtgcccctatccacgaccatttccgcactacattagcacagttagaccccaattgcagttatctgttcatgaaacccaacagcgtattccatgagtcaaaaatcacggtacgcttctggattgtcaccatcgtactcgctgcaattacgattattacattaaagataagataagataaacgaagattatggctaaaagaattgtcatactaggagccggagaaagcggtgcgggagcagccgttctggcaaagaaacaaggtttcgacaccttcgtttcagacatgtccacgattaaggacacatacaaaaacatgctgaacgagcgaggcatcgaatgggaagaaggcaaacataccgaatctctcattctgaatgcggatgaagtaatcaaaagtccgggtattccgaatgatgccccgatgattcttaagttaaagtcacaaggcacccctatcatctccgaaatagaatttgcgggacgttataccaatgccaaaatgatttgcattacaggaagtaatggaaaaacaacaactacttcgctgatttatcatatcttcaagaaagcaggtatgaatgtgggactagccggaaatatcggccaaagtctggcatatcaggtagcagaatgcaactatgattattatgtgatcgagttaagcagtttccaattggacaacatgtacaagttccatgccaacattgccgtattgatgaacatcacgccggatcatctggaccgttacgaccaccagatgcaaaactatgtggatgccaaattccgcattatccagaaccagaccccggacgatgccttcatcttctggaacgatgaccccatcatccagcgtgaattacacaaatatggcattcatggccattactacccttttgccgaaaggaaagaggaaggaaccgccgcatatgtggaacaggacaaggtttattttacagaaccaatcgctttcaacatggaacaggaggaactggcgctgaccggaacccataatctgttcaactccatggcggccggtatctctgccaacctggcgggtatccgcaaagagtgtatccgcgaggccttgggtgatttcaagggagtggaacaccgccttgaaaaagtctgccgggtaagaggggtggattatatcaatgactccaaggctaccaatgtgaattcctgctggtatgctttgcaaagcatgaaaaccaaaaccatcctgatattaggcgggaaagacaaaggcaacgactataacgaaattgccgacttggtaaaagaaaaatgtaccggattgatctacatgggattgtacaatgagaaattgcatgatttctttgacaagttcggcctgcctgtagccgatgtacaaagcatgaaggatgccgtagacgctgcttaccggatggccaagaaaggcgaaaccgtattattaagtccatgctgcgctagcttcgaccttttcaaaagttacgaagaccgtggcgagcagttcaaggaatgtgtaagaaacctgtaatatagtattaaggtatatagataatggatctgataaaagacttgttcaagggcgacaaagtaatctggattattttcctgtttctttgtctgatctctatcgtcgaggtatttagtgccgccagcacgcttacctacaaaagtggggatcattggggacctatcacccagcacagtgtcatcctgatggtaggtgtgtgcattgtggtactggtacataacattccctacaaatatttccgtgtgtttcccgtcttcctgctacccctatcgacattattgctgatatttgtaatgggtatgggattgattaccggagaccgtgtcaatggtgcagcccgttggatgactttcttcggtatccagttccagccttccgaactggcaaaaatggccgtgattattgtcaccgcatttattctatccaagtttcaggaagaagacaatgccaatccgaaagcatttaaatatatcatgtggatcaccggaattgttttcattctgattgctcccgaaaacggctctaccgcagcactgcttttcggagtagtctttttaatgatggtgatcggccgggtaccctggaagcaattggccaagttaatgggaatagccggagttatggtggctttttttgtaggcatagtgatgattatgcccacacacaaactgaacaaagtccccatgatgcaccgtgtagaaacctggcagaaccgtataaaaggcttctttgaggacaaagaagccgttcccgccgccaaatatgatatagacaaggacgcccagatagcacacgccaatattgctatcgcctccagcaacatcataggaaagatgccgggtaacagtgtgcagcgggatttcctgtcacaagcattctcggacttcatctttgctataatcatagaagagctggggttgctgggaggcgcctttgtagtgattctctacatctggctgttgatgcgggcgggtaaaatagcccgaagaagtgaaaaaagttttcctgcctttctggtgatgggcatcgccctgttgctggtatctcaggcgatgcttaacatgatggtggccgtaggtctgttccccgtcaccggacaacccctgccgcttatcagcaaaggaggaacctctacactcatcaactgcgcctacatcggtatgatattaagtgtcagccgctacgtggctgagaaagaagaacagaaagccgccgagcaacaagcgcagaaagaagccgaactggcagccaagaccgaacggcatcaggaaatggtagctgccatgcaggaagccattaccacacttccgtcgggtgacaatgccaccacttccctcccgccggaggagaactcgctgcccgatgacttgaaggcaatgctgaatgcagccgggaagcgggagccggaagaagaaatataatataaaccattcattttaaaagtattatttatacttttgcgaataattcgactaaaaaggaattatggaagaaaatttaagaatcatcatcagcggaggaggaaccgggggacacattttccccgcagtctctattgccaacgccatcaaggaacaacatcccgaagcggaaatcctgttcgtaggcgctgaaggcagaatggagatgcaacgcgttcctgctgccggataccctataaaaggattacctgttgccggattcgaccgtaagaacttattgaaaaatgtttcggttcttttcaaattggtcaaaagccagctattggcacgtaaaatcatcaaggatttcaagccacatgcagcagtaggtgtaggcggatatgccagcggtcctactttgaaaatggccgggatgatgggtattccgacactgatacaagagcaaaactcttatgccggagtaaccaacaaactattggcaaagaaagcctgcaaaatatgcgtggcatacgacggcatggaacgtttctttgaaaaagacaagattatcctgaccggaaaccctgtccgccaaggactgcgcaaccatcacatcagccgtgaagaggctatccgctccttcgggctggacccatccaagaaaacaatcctgattgtaggaggaagcttgggagcacgcaccatcaacaactgcgtgatggaaggtttggacaagattaaagcatccggcgcgcagtttatctggcaaaccgggaaaatatatatcggcgaagcacgcgccgcagtagcccaggccggtgagttaccaatgctccacgtaaccgattttatcagcgatatggccgccgcatacagtgctgccgatttaataatcagccgtgccggagcaggttccatctccgagttctgtttgttgcagaaacccgtcattctggttccgtcacctaatgtggccgaagatcatcagaccaaaaacgcactggcgctggtcaataaaaacgcagcactctatatcaaggacgccgctgccaaagaagctctgctggacaaagcggttgaaaccgtgaaacagccggaaacattgaaaagtttaagtacaaatattgctaaattagcctttaccgactcagccaacgttattgcccgggaggtattcaaactggctgataaatacagaaaagaaaatggacgttaacacattaaaatcagtttatttcatcggtgccggaggtatcggcatgagcgcattggtacgctacttcctgtcaaaaggcaagaaggtaggcggatatgaccgtacgcccagtgaactgacagaaaagctgatagaagaaggagcagccatccattacgaagaaagcacggaactgataacggatgcattccgcgacccggcaactacattggttgtctatactccggctgtccccgatacacataaagagtttacctatttccgggaaaacggtttcgagatacataaacgttcgcaggtattgggaatgcttacccatgcaggaaaaggactttgtgtagccggcactcacggtaagaccaccacttctaccatgacagcccatctgttacaccaatcccatgtaggatgcaacgcctttttgggaggcatctcaaagaattacggcaccaacctgctgttgtctgacagcagtgaatacatggttattgaagccgacgagttcgaccgttctttccattggctctcgccctacatatcggtgattaccgcaaccgatcccgaccatctggatatctacggaaccaaagaggcttatctggaaagcttccgcaaatatacctcactcatccagccgggaggtgcattgattgtacgtaaaggcatcgagctgcaaccggctttgcagaatggtgtgaaactgtacacctattcccaagaagagggtgactttcatgcagagaatatccgtattgggaacggtgagattttctttgattacgtatcacccttgggaaatatccccaatatacagttgggtgtccccgtcagcatcaacattgagaacggggtagccgccatggctttggcgcagatgagcggattgactgacgaagaaataaagagaggtatggcaagtttccgcggagtagaccgtcgtttcgatttcaagataaagaacgacaaggtggttttcctgagcgactatgcgcaccatccttccgagataaaacaaagcatactctccatgcgtgccctctatcgggacaagaagctgacggctgttttccagccgcacctctacacacgtacccgtgatttctacaaagatttcgccgacagcctttccttgttggacgaagtcatcctggtagatatctatccggcacgcgagcaacccatccccggcgtcaccagcaaactgatttacgaccatctgcgtccgggcatcgagaagagcatgtgcaagaaagaagaaattctagacgtactgagcaagaaagatatagaagtattaatcaccctgggcgcgggcgacatagataactatgtaccccaaatctgcggattactgaataaaaaatgataaagaaaattctcatactcctgtttctgttgctgataaccgcctaccttattgtagccgttaccgctttcaacaccaagcctgccgaccaggtttgcaagggtatggaattgattatcaaggacagtatagaccatggtttcatcagccagaaagggatactccgcttactgaacggtaagaagctctcccctgtgggtaagaagatgggcgacatcaacacccgcctgctggaagaagaactcagccaacatcccttgattgaaaatgtggaatgttaccgtacaccgggatgcaagataggtatcgaagtgacacagcgcctccccatcctcagagtgatggcaaacaacggagacaactattatattgacaataaaggaaaaatcatgccgatacccaacagttcggcacacgtagctgttgttacaggatacgtggatcgtgattttgccgtcaaggaactatataccttaggagtctttctacaggcccatccgctatgggatgcccagatagagcagatcaatgtgacacaagccaaagaactggaactggttccacgggttggcgaacatatcatattcttaggcaagcccggaaattatgaggaaaagttcgagaaactaaaaactttttatgagaaaggactgaaccaagtaggctggaacaagtacagccgcatcagtctggaatttaataatcagattatttgtactaaaaaagagaagtaagatatggcagcaacagattttatagtagcaatagaactgggatcctccaagatcacaggtattgcaggaaagaaacatgcggacggaagcatacaagtgctggccctcgccagcgaaaactcttcggattttatccgtaagggagtgatttacaatctggacaaaaccgcacaaagccttacttcgattatcaagaaactggaatcgacattaaaggcttctatcggaaaggtctatgtaggtatcggaggacaatctctacgcaccatccgtaatacggaggtacgtcatctggaagaagaaaccaaaatttcacaggaactgattgactccatcatggacagcaaccgcgaagtccccatcatagaccaggaaatactggaagtggcaccccaggaatataaagtaggcatcaacctgctggccgatcctgtaggagttcccagcgatcatatagaagggcgtttccttaatatcatcgcccgcagcagcgtgaagcagaacattgacaaatgtttcaaacaggcaggaatcgaaatagccgactacatcatctcaccgttggctctggccaatgccgtactgaccaacagtgaaaaacgttcgggctgcatgttcatcgactttggcgcagatacgactactgtatctgtctacaaaaacaacatactccgccatttggcagtcatcccactgggaggaagcaacatcaccaaagacatttgcagccagcagattgaagaggaagatgccgaagaactgaaaaagaaatacggcaatgcctatgccgacaagtcggaagacggagatgacaaccctacctactcgctggacgggaaatgcagtattgagtcacacttactggaagacatcgtagaagcgcgtgtcaatgagatactggccaatgtatggaaccagattgttctttcgggatatgaagacaaactgctggcaggagctatcattaccggcggtgctgcaaatctaaagaatatggaggaagcattcagcaaccgtaccaaagtagaaaaggtaagaatggccaaagaaagccagctaagcctgaaaggtggcatgatggaactgaaaaaagatggtacatgcaatacaatcatcgctttgctaggagccggaaaagagaactgttaccgcccggaacgtcctatccaagtacctctcttcgatgaaagcggcgagaatgtggaagacaaaaggaaaagagagaaagaagaagcagccagaatagcagcggcagccaagaaagcagaggaagaggagaagctgcgaaaagccacttgcgagagcctgataagaaacgcaaaagagctgaaagaggcaggcaaatacaaaaatgccttgtcgcaactggccaaagcacgcgatctgggagtggcagaagctttgaaccaaatacgcgacctggaaaaagaaatcaagagtttgaaagaagccaacaatccgatcaaacggctgaccgacttgtttggaaggattctggaagaataataacgaattacatcaccttaatataatatagaagattatgtctgatgaaactataatgccattcgatttcccggcagaaaacccgactatcattaaagtaatcggtgtgggaggtggcggcggcaatgccgtaaatcacatgtataaagaaggtatacacgatgtaacatttgttgtgtgcaacacagataaccaggcgttggccgaatcccccgttcccgtgaagttgcaactgggaaaagaaggattaggagccggaaaccgcccggagcgtgcacgtgaagcagccgaagaaagtatagaagacgtaaaaggaatgttgaacgacggctgtaaaatggtatttatcactgccggaatgggaggaggtaccggaaccggtgcggctccgatcattgccaagacagccaaagatatggatatcctcaccgtaggtattgtcaccattccgttcctttttgaaggaaaccggaagattgaccaggcactggacggcgtggagaaaatgagccagcatgtagatgccctgctggtgatcaacaatgaacgtctgcgtgatatttattcggacttcagcgtgatgaacgctttcggcaaagcggatgacactttatccatagcagccaagagtattgccgagattatcactatccgcggtaccatcaacctggacttcaatgacgtgaaaacagtactaaaagatggtggggtagccattatgagtacgggatacggcaaaggggaaagccgcgtgagccaggctatcaatgatgcgctccattccccgctgctgaacaacaacgatatcttcaactcgaagaagatcctgttcaacatctctttcagcaccaagagcgagttgatgatggaagagatgaatgaggttcatgacttcatgagcaaattcggcaaagacgtggaaaccaaatgggggctctatatcgacgagtcgctggaagaacaggtgaagttcaccgtacttgccaccggcttcggcatcaaggatgtaccgggcatggacaacatgatgaacaaacgcaccatcgaggaacaaaagaaactggaagaactggaagaagaggaacagcgcaaggatgaacgtcgtggagattactacggcaaagacaccttcaagaacagcaacaagaagaaacgccataacatttacatcttcagcctggaggatctggacaatgatgacattatcagtatggtggaaacgacccctactttccaacgtaccaaaactgtgttggaaagtatccagtctaaagcaatagccgaagaagaggaaacattcaataacgatgccgaaaacggcggaataacgatcacattttaacaactaaaatagaaaagaaccatggatttatttgacgtaatcagcaacgatatcaaagaggctatgaaagccaaggacaaagtgaaactggaaactttgcgtaatgtgaaaaaattcttccttgaagcaaagacagcaccgggcgccaacgacactttgacggatgacgctgcattgaaaatcatgcagaaactggtaaaacaagggaaagattcagccgccatttaccaaggtcagggccgcgccgacttggctgaagccgaactggcccaagtggcagtgcttgaagcctatctgcccaaacaaatgagtaacgaagaactggaagccgctttgaaagaaataattgcagaagtgggtgccgccggtcctcaggatatgggtaaagtcatgggtgtcgccaccaaaaagttggcaggcaaagccgaaggacgtgccatctcggctaaagtgaaagaattactgggataatactccggcaatccatattcgagaaacgaaacttctgccccgattcatctttacgggcagaagtttcgttttttataaaatcagtgagaagcaaacatatgcagtaccctatccagcttcccgtttatcattctcacttcaccaataccctggaattcaaagtatccttcagtgtgttcagccacaataaaaatctgatatacagcgcataaggctgacagtagttccttcagtgcgctgtcagcaccttcagccgccgcaacacccgcaccggaccgatatccttgaccatcatgctaaaggacaagaatgagtcatacaatatcgtggtcaaaagattgcacctgctttccatcttaactttcaagacaggaagaatactcatttgcttcctgtaagcattcggcctcgtgcgtgtttttttcccctcttttccttcctacctttgtgggatcattagactttttgttttaatatactatatagaatcgcggagacgcttacaggactgacaggaggctgaaggggcttctgtcagtcttattttttgtgtgacagcgtgttaaccgtgctgaatggactgaaggcggggtgcatgaatgccaaaaaacatactataagaatctttttaaagagccgttttctcaagaatttgtactaagtttgcaaccaaactacataattaaaaaaactatgattaacagatttgtattgaacgaagtatcttacttcggtccgggtgcgcgtgaagtgcttccacaagagattaaacgtttgggcttgcataaggcgtttgttgctacagacaaggacttgattaagttcggtgtggctgataaagtgttgaaagtcttggagaatgcaggtattccttatgaaatattcagtgaaatcaaaccgaatcctaccgtaagcaatgtaaaggcgggagttgaagcttttgcaaaatcaggagcggactttattctggctatcggcggcggttcgtctatcgatacttcgaaagcgattggtatcatcactaataatccagacttcagtgatgtggtgtcactggaaggtgtggctcctacaaggaaaaagtcagtgcctatcattgcactgcccactaccgccggtactgccgccgaggtgactatcaactatgtcatcacggatgaggaaaaccataagaagatggtttgtgtagacccgaacgatattcccgccatcgctattgtggatgcggaactgatgtacactctgcctaaagggctgactgcttctaccggtttggacgcactgacccacgccatcgaagggttgataaccaaaggcgcttgggaaatgagcgatatgttcgagatcaaggcgatcgaaatgattgcccgttatctggaaaccgctgtcttcgagcctaccaatgcggaagcccgtaacggtatggccgtggcacagtacattgcaggtatggcgttctctaatgtaggcttgggcgtggttcacggtatggctcatccgttgggagctatcttcgatattcctcacggtgtggctaatgcactgttgctgcctgtcatcatggagttcaatgctccggctgctttgtccaaatatgtagatatcgccaaggcaatgaatgtgtacaaggatggcatgagccgggaagaggctgcgaaggctgctgttgaggcggtgaaggcattgtctgtcaaggtgggtatccctcagcatttgtctgaactgggtattaaggaagaagacttgccccgtctggccgcttcggctattgccgatgtgtgtacgccgggcaatcctcgtgaagtgacggaagaaattattctggaactttacaagaaggctttctaagcgtaattcttttgtaataaaagcataggtggtgtgtggatgtgcagggcatatccacacactttttttatctcctttctgttttttgaattgttatgtgagtttcatctttttgtatttggattgaaatgtgcagttcgtttctttgcggcagaaaacaataaacttaaagttatgaaaaagaagttcattttaaccgttgcttttttgagtatcagtttgtttgcccaacagatgtgggctatgccgttttatccggtacgtgataaaaaagagaatgtgaaaacggatgcatcttcggctaaggtggaaacatgggagttttactctactgttgaaaccccttcttccgaagagctggctgcattggtttctaatcataaattaggtaagaaggtagccttcctgtatgattcatttaaagatacttatgtggtgaaggaagaggtggtacccggagatccgacgcgtcgtacggtgattcgtaagccggaaatctacaatgcagtacgtaccattgaaaaagaactgaaccgtcaggtaaggaaagacctgctgccgcaggataaggcggagcaggagtttacaggggtgctgaaagtggcgttggccgctatcgactcggatacggagtcttttgagactgctttacaagagaataaaaaggacgtatctcatttgttgggtgtattccgccgtgtcagccttaaaagtatctattgaattctttcttttcaggataaactaacaattatatataaatgaaaactaaacagtgcttggtcattgttatgaccttgctatgcctttgcgtgaaggcgcagaatctcagagtgaccggtgtggtgcgggataagtcggatgtgattatcggtgccagcgtaatggttaaaaactcaacagtgggtacggtgacagatatggatgggcgttattcagtggaagtgcccgccaatggtgtattgattttttcttatatcggatatactccggtagagaaacaagtagatggacaaacggtgattaacgtgacgatgaatgacgatgtgcaggccattgacgaagtagtggtaactgctatcggtatcaagcagcagaaaaagaagttgggatatactacccaacaagtcaataccgaggctttagaccagccgggtacggtgaatgttggtaatgccttgtcgggtcaggtagccggtttgacggtaaataatcctaccggtatttttcaggctccttcgttttccttacgtggaaagactccgttgatggtgattgacggtgtgcctgtggagtcggatctttttgacgtatctcccgaaaatatagaaagtattaatgttttgaagggaactgccgccgctgctttgtatggttcgcggggtaaagacggtgctattttgatcactaccaaactggcgaaagaggatggattgactgttacggccggattgtccagtatggtttctgccggatttacggtctttcctgaaactcagacagagtttggttcgggctctaatggtcagtatgccttttgggatggagcagatggtggtatctcggatggagacatgacctggggacctcgttttgccgggcagaaaatagcacagtggaatagtcctatccgtaataaagaaacaggagaaacgattccttggtggggggatgtttccggtacgatttatgatgaccagtctaagtacgaacgggtgcccatcgcatgggagcctcatgataacctgagggactttttacgtaccggaattattacaaaagcgactttttcagtggcaagcaaaagtaaaaaagctaactataattttaacggtgatttctccaatcagcgcggacaggttcccaatacttcggtttatacggggggattgaactttaacagtatgtataaccttagtaactcggttactttatcagccaatctttcttataacaaggtatattctcccaattatccacgttatggatatggaccgaaaaatcatatgtataccattttgttatggatgggaaatgatgtaaatggaaaggagttggccgagcattattatcgtccggactctgaaggtacacgtcaggccaactacaactatgcgtggtataataatccttactttgctgccaatgaactgacgcaaaagcatgaccgtaatacaatgaatggacaactgaaactgaactgggatgtaataccggggctgagtttgcaaggacgggctgcgggacgtttggaaagcacatttgaagatatgtctgttcctaagtcttatatgaactatggtgattcgcggaatggcgactacaaaacgtggaatactgatcagctggacatcaatgcggattttcttgctacttacacacgtgctttcagcaggaattttacgttgactgtcaatgccggtacttcactgtattaccgtcagattcggaagcaaagccagtctacagacggactgatcgtggcgaaagtatacaatttgggtaatagcctgaatcctgtaagcgctaccaactcgatgaacgaaaaagctatcgagagtgtttatggttctgtgaatgtagatttgtttgagtctttgtttcttacatttaccgggcgtaatgactggtcttctactttggcaaaagggaataactcctatttctatccttctgtgtcattaagtacattggttaatgaatatgtgaaactgccttcatggatggattatctgaaagtaaatggtgcatgggcgcaagtttccagtgaccttgatccttattctttgtatgctacttattccaatggcacactgtatggcagtattccgtccgtgacttatccgggtacgttactcaatgcgaatatattgccgcaaaaaacaacctcgtatgaggtgggggtttctacttcgtttttgcataatcgcattggaattgatctgacctactatcatatgctggatgagaacagtattatagaactgcccatatcatctgcctcggcatttaccaaacgttatgtgaatggtaacgaatacacaacaaacggtttcgagctgattgtttccgccactccggtaaaaaacaaaaactttacctggaatgtagctaccaattggagtagtaatattcgtaagctgaccgggatttatggagaccaggagaagttcggcgatttgaaaaaaggtgaccgggctgatgctatgtatgctaccgagtgggaaaagacaccggatggccggttgatattggatgcgaatacgggtttgcccactcagagcgcttttaagaccaaagtaggaaaccagtctcctgatgttcgtttcggattgcagaatactttcaagataaaggattttactgtcaatatagatatggacggagctatcggaggaacgttgatatctactaccacgcagaaaatgtggtggggaggaaagcatcccaaatctaccatgtatcgtcaggaagaatatgataatggtggcaagcctgtttatgtgcccgaaggtgtcaatatagtaagcggtgaggtgacttatgacgtgaatgggaatattgtttccgatacccgtgtctataaaaagaatgaaacagcggtaaacatacagacttgggcccagaattatccttatcgtgccgtggtgcgtacagaagaaagcgagttgtttgctaatacgttcagccgttctttcctaaaactgagacgtgttgcagtgacgtatgatttgactaagttcattcagtcacagtttataaaagggctggatgtcacagtgtttggaaacaatctggccgtgctgaaaaagactccttatttggatccggactttggtgccagtgatggagatttgcaggatccgtcggcccgttatgtaggagtgagtgctaacattaaattttaacgtttattcaaaatatgatgaagaagtatatcaaatacatggcatctcttcttgccgtatcctttgcaatgagtgcttgcattgatttggaagagatgaatgtggatcctaataatgccactactaccaatccttccctgttgttgaccggagttgcttatagtgctttcaatcaaaccagttcggatgcttgccatgcagccaagatgctgattctgacttcgggagaaagcaagtatcaggtttataaatggacgcgtggggattttgattattatagcaatttgcgtgatgtgaccaaaatgtcagaagaggccggagaaggaagtgcttatcaggctttggctcatttcttccgtgccaattatttctatcagttgactctggactttggaagtattccctatacggatgcgcttaaggcagaaacagatgcgaattaccagccggcatacgattcgcaggaagttgtgctggccggcattttgaaggaactggaagaggccgataaaatgcttgaaggcagtgatgagattatttcgggagatattatctacaatggcaacttggttaattggagaaaattgattaatgcttaccgcttacgtattttgatgtctttgtcgggaaaagagaaggtaggtgatatagatgttaaatcggagttttcaaagattgtagccgacggacctttaatggaaagcttgtcggataacgggcagttgatctatcttgaccagcaggataaccgttatccgtattttaatgacagcgatttcggttcggggcgttttatggattccacttatattgctgcattggctacacggcaggatccgcgtttatttgctgttgccacgcaaactccgaatgctgaaaaagccggaaaagcgattaatgatttcagctcttatgacgggggtgatccggctgttccttatagtttggttaatgataaggcggtggctggaaactgttccaagcctgctccccgttattaccagactccgaccaatgagcctatggtcttgttaggttacgttgaacagcagcttatattggctgaggctgtagtaagaggatggattcagggagatgacaagatttattatgaatcggccgtcaaggcgtcttttgagttttatcagaaatatgctgtgtcggtagctgattatctcactcaggatgcagcggcagaataccttcgaaatgacaaggtggcttattcctcttccctttctactgatgagaagatagagcgtattattatgcaaaagtatttgccgacatttttgcagggaagtgtatggctaccctactatgaggcgcttcgtacggggtatcccgatttccgccgtgccgcaggagttagtctgccttatcgctggatgtatccgcaggatgaatataataacaatgccactcatgtggaggctgctttgaatgagcagtttggtggaagtgataaaacctcggataagccttggtggttgcagtaatcagtttaaataaatttttaggatgatgaaaaagataaaaacattatgtggtgtgttggctctgctttgtgtagggatgatgccggtaagcgcgcaaaatgtgctgaaattcaatgcagacaagaagtttaagattgttcagttcactgatgttcattgggtaccgggagactctgcctcggaagaagcggcggagcgaatgaatgaggtcttggatgttgagaaaccggatttggtgatttatacaggtgatttggtgtttggcaagccggcgagcgaggcattgtctaaagctttggaacctgttgtttcccgccgtttgccttttgccgtgacttggggaaaccatgatgatgagcaagatatgacccgtattgagttactggaatatatcaaagatatgccgggtaatctgacctctaccacggcagggatttcgggagttactaattatgtacttcctttgaagtcggaagacggaaagaaggatgcagctgtgctttatgtcttcgatagcaatgcgtattcgtctttgaaacaggtaaaagggtatgattggataaagccggatcagataaattggtatgttgagagcagtgtgggatatacggaacgtaatggtggcaagccactgccctcgttggctttctttcatattccttttccggaatataatgaagcggcgcaagatgaaaatgcgttattgataggaacacgtaaggaaaaggcttgtgctccgttgattaatacaggtttgtatgctgctatgctgaatgcaggagacataatggctacatttgtggggcacgaccatgtgaatgattatgtagttgattggaaagggattttgttgtgctatggacggtttaccggagggaataccgtttatcacgatattccgggaggaaatggggcacgggtcattgaactgacacaaggagtgcgctctttcaagacatgggagcgtttggagggaggaaagattattaatgaagtaaattatccgtctgatttccaaagagaataatagtcagttgggcaggatagaggtattctcagtacctgtccttccggtgacaagactgtttcgtcatttgttatacataaattattgtcacagcttcatacatccctgtcggcattctatggatatagttaataatggccggcagggtgatagaatattatgaccgtttcagatattcgtaccctatccggcaatacaggcattttttcttatcgcaatattctttctttaattgtatcaaagcttggctgtcggcggcattggaggctttcattccgcattgttcccacatgcgggtgatataattgttctccgctttcaattcttccagaaaactgccggcacgtgcacaaagtacacgattccctttatgcagtccgtaagcatagagaaatgtcactaccgtgttgataatgagtaaatccagtgaggtgttacttagagtcttcggacgggaaggggaagaaccgccaaatgtataatgagtgagccagtattctgacgttcctcctttcagaatatctctgacaccttgtagtgtctccgtttccatgatgcgagagagcagtccgtaggcacgatgataaagacatgccaactgtgcaatccgtatatgcggaaaattagcaggacgtagccggagaaaacgccatagggaagcatccatcgggataagtccgaatttatgctgtagataggtgtactctttttttagccggagatagtatccgtctccatcagaatcttccagaatgccggcttgtccaaagaagatggcttctatctggaaaaggtcgttccgatgcttgtctaccgcccggaagggaagccgatgagcccaggtttcgaaagcgtctccgttcagcccgaaaccgaaattacgtgccagtgtgataaaaaaagcatcttcccaattgccttgacaacgttttaaccgttcattcaataaggtcgctttttgctcgaatctttccatctgtaaggcagtcatccatgagtgggcggtgaaaggggggagtgaaggaatgatgcggtaacaaggggggtagctgtctgtttccaacagttccttgtagttggtgcggaccgcttccgggcagatgagttgtatttgggggattctttctccattgctcctgctgatttccgtatctatttcggaggctatatgcagaatgacagagttgtaaccggcatctgcatgatgtccgtgtttgaaccagtctgaagatctttcatgtatctcgatattgcctatccaaagcacaccgtccagcttgagcttggcattaaaaaaatcgggaccggcgtcggtattcgccagtcccgtatctataacttccacttgttggccggttgtcgttttcagttctttgagaggaaatattttatgtttccatacatagtgtaatagttgttccatgttaatgaggtgtaaatgtttggcaaatgtaatggtttacaacgaaaaacgctatctttgtggctgaaataacattcgtaattatgaaaatagcattaataggatacggaaagatgggcaaggagattgaaaaggttgcagttgcccgcggacatgagattgtgagtattatagatgttgataatcaagatgattttaattcggaagcatttaaatcagcagatgtggctattgagtttactaacccgatggtggcatatgacaactatatgaaaacttttgctgccggtgtcaaattggtatcgggcagtaccggatggatggacaaacatggtgatgaggtgaaagaattatgcacgaaaggtggaaaaaccttgttctggtcgtctaacttcagtctgggtgtcgctatattctctgctgtaaataaatatttggctaaaataatgaataactttcccgcttacgaggtttccatgaccgaaactcatcatattcataaactggatgcgcccagcggaacagccatcacgctggccgaaggaattctggaaaatatgaaccgcaagagtaaatgggtgaaagggaccatggtggcaccggatggaaccgtgtcgggaacatcggaatgtgccgagaatgagtttcctgtaaattcgatccgtgaaggggaggtgtttggtattcatactatccgctatgactctgaggcggacagcatctcaattacccatgatgcaaagaatcggaaggggtttgccttgggagctgttttggcggcggaatatacatccaggcatgaagggttattaggaatgagtgatttatttcagttttaagatatgataagagcaacacgtacacagtggattaagtttgccgttgttctggcgctttacctgatatttcttgtctggttgagaagctggctgggattggtggttgtaccgtttatcttcgatgcgtatatcacaaagaagattccatggacttggtggagagagtccaagaaccgtcatgtagtgactgtcatgggatgggtggatgctattgtattcgcactggtggcggtatactttgtcaacctctatttcttccagaactatgtgattccttcttcttcgctggaaaaatcattgctgacgggtgattatctgtttgtgagtaaaatgagttatgggccccgtgtgcctcagactccgctgcacatgccgttggcacaacacacactgccgttttttaattgtaaatcataccttgagcatccacaatgggattataaacgggtgaaaggtttgggggatgtacagttgaatgatatcgttgtctttaactttccggccggagatacagttgccaccggtgtgcccaatgatgatatttaccgtctgagttatggcgcaggcaaggagctggcaaaaccggtggatttggcttccatgactccggagcagcaacgggtggtctatgattattattatcagttgggacgggagtacctgaaagagaatccacagaacttcggtgagataatcagccgtccggtagaccgccgtgagaactacgtgaagcggtgtgtgggtttgcccggacaaacgttggagataaaggatcgtattatttatttggatggtaaagctaataaagagcctgataatgtgcagtatcgttatctggtgaaaaccaagcgccctattcccgatgacctggctcatgaactgggtatcagcaaggaggatatgatgatgtattatacggatgcttctgtttataatatgcctctgacggaaaaagcgaaagctggtttgttggcgcgtaaggatattgtagtcagtattgagaatacaccggctgatgatgcggggggcttgtacccgctgaatatgtataagaactggactacggataactacggacctgtatggattcccaaaaagggagagacggtgaaactcacgatagagaatcttcctgtttatgagcgtcctattcatgtttacgagggtaatgaactggcggtgaaagatggaaagatttatattaacggcaaggaaaccgatgagtatactttcaagatggattattactggatgatgggagataaccgtcataattcggctgactcccgtttttggggatttgttcccgaagatcatgtggtgggaaaacctatctttatctggttgtcattggataatgaccgtggctggctggatggaaaaatacgttggaaccgattgtttacctttgtagataacattaaataaattgcgcataccctgtattcctgtatggataaaagcaatgcttactgctgtcattctggtactgttggtaaagacatttgctttcacctcctgcaccattccctctaccggtatggagaatagcctttatcaaggggaaagggttttggtgaataagtggagttatgggtttcgtgtgcctttttctatctggcggtggctgggaaaaactgccgggaaaggggatattgtgttgttcaacaatcctaatccacggtctcctcagacgtcggtgggcaatcgggaagtgtttataagccgtgtggtaggagtacccggagatacgttgatgttgaatgatgaactgtgggtgaccgacgaacaagtgttgagcccggatagtaaatctttgtatgtctattctcatacggaagaagaaacgatgcaggctgccatgcagcaagtgaacattcagggaaacaggttggtggggtatgccgaggggaagtatatacgtaccttcagtcattatgaatattacctgttaaaacaaaaactggcgggaaaagtggatttgattcctctttatcataaggatataagcaagagccatccctttgtgatcccggaaaaagggaaacctgtcaaggtatatccttggaatgtgaccttgttgtgcaatactattgtccgccatgaagggagagtggcttctgtcaggggagataccctgtatgtagggggaaaacctgtagaagcctatacatttaataaaaattattactggatggcatccaataatccggtaaatctgtgtgattcgcgtttattcggcctggtgcccgatgaccatttgatcggtaaagcttggcgcatttggttttcatccagaaaagggcgcatttttcaacgagtgcaataatggagaatacgatatatttaagttcggcctatctggccccggtggaatattatacaaaactgtttgcctgtgagaaggcctatgtggaacagtatgacaattatgtgaaacagacttatcgcaaccgttgtgtcattgcggcagccgacggtccgctggcactgactatccctacggaaaaaagcggtacgcctaaatgcctgatgaaggatgtccgtatttcggatcatggcaattggcgtcatatacattggaatgctttggtggctgcatatagaaacagtcctttctttgagtactatgctgatgatttccgcgtcttttatgaaaagaaatatgccttcttgtgggattataatcaggaaatttgttctttagtatgcgatttgatcgatattcatccccatatggaaggaacaacggaatattgcatggaatttgttccgggtgaggttgattttcgtgagactattcatccgaagcgtgactggcgtgaggcggatgctgacttttgccctaaaccttactatcaagtttttgatgccaaatacggttttctgccgaatttgagtatcgccgatcttttgtttaatatggggccggagagcctgattgttttgcgagatagtgttaaaggtataaaccataaagaataatatcatgaataatttgtttagtgtaaaagaccaggtggtggtaatcaccggtggaacaggggttttgggaaaggctattgccgcccatttggcagaagaaggtgccaaggttgttatattaggccgtaaggcagaagtaggaaatgccattgtaaacgaaatcaaggccaaaggcggggaagccatgtttcttgtaacgaatgtgttggatgaggctatattggagcagaatctgaaggatattctcgcagcatatggtcgtgtagatgcattgctgaatgcagcaggaggtaatatgccgggtgctacgattgctcctacaggaaatttctttgatttgaaggtcgatgagttccagaaagtgcttaatctgaatcttaccggaacagttctgcctacacaggtatttttgaagccgatggtggaacagaagaaaggagctattgtgaacttctcttctatggcggcattccgtccgatgacccgtgtatgtggttatgcggctgcaaaggcgggaatctctaatttcactgcgttcatggccaatgaagtggctacgaaatttggtgaaggcatccgcgtgaatgccattgctccgggattcttcctgaccgaacagaaccgtactttgttgacaaacgaagatggtacatatactcagcgtggtaatgatgtgattcgccagactccgttcaaacgtttcggtaaagcagaggaactgtgtggaaccatccagtatctcatcagcgatgccagcagctttgtaaccggtacagtagccgtagtagatggtggtttcaatgcatttgccatgtaacaagtctttagtttttaattctcaatttttttatttgatatgattttatgtgagcaaacatggcgctggtacggaccgaatgatcccgtatcattgtgggacatcaaacaagccggagcaaccggtattgtcaatgccttacatcatattcccaacggtgaagtatggacggtagaggaaataatgaagcgcaagaaattgattgaagaagcaggattaacttggagtgtcgtagaatccgtgcccgtacacgagcatattaagacacagacaggagattatctgagatatatcgagaactataaacagagtttgcgtaatctggcagcatgtggtatctatattgtgacttataacttcatgcctgtactggattggacccgtacggacctggcatatacgttgcccgatggttccaaggcattgcgttttgagcgggctgcttttgtagcgttcgatctgtttatcttgaaacgtccgggagccgaaaaggaatactcggccgaagagatagaaaaggcaaaagcgcgtctggcacaaatggatgaggaagaaattcatcgtctgacacgaaatatgattgcaggattgcccggttcggaggaaagttttacattggagcaattccaaaatgaactggaccgttacaaggatattgatgcggacaaactccgcaataacttgattttcttcttgaaagaaatttgtccggtagccgatgaagtgggagtaaagctcgttattcatccggacgatccgcctatgtctattctgggcttgccgcgcattatgagtacggaggcggatttcaagctgttggtggaagctgtacctaatccgtcaaacggactttgtctgtgctgtggctcatttggcgtatctgcacagaatgatttgccgggtatcatggaacgttggggagaccgtatcaattttgttcatttgcgcagtacccaacgtgatgctgaagggaacttttatgaggcgaatcatctggagggtgatgtggacatgtatcatgtagttaagaacctgttgaaagtgcagcaacgtcgtggaatatctattcctatgcgtccggatcatggtcatcagatgatagatgatttgaacaagaaaacaaatccgggctattcttgtttgggacgtatgcgtggccttgccgagcttcgtggtttggaaaaaggaatagcgatgagtatggtggcagagtaacttctttttaacatataaaaataagacctgaatgtcttccggtatccggagatcttcaggtcttattttgtttaaaggctggataataggggctttctagacaaatacagatattaattagacaaataaagaggtgctggcggaatgggaacgcctatatttgcaacagtttttaatctaattaatccttaaattcttttattatgaataaaaaaatgaaactgctttcagtccttggattggtgacagctattctgtttttgttctcgccgatggtgacagctcaatccttatccatcagtggtaaggtaattgacaaaaacagtcaggagcctgtaattggggccagtgttttaattgaaggaacctcaaacggtacgataaccgatttggatggtaattttatgctttccaatgttccatccaaaggaaatctagtcgtgtcttatattggttatgctacgcaaactcttccaatcaatggaaaaactagtttcagtattgtcttggctgaggataccgaaacgttggatgaagttgttgtggtaggttatggtgtgcagaaaaaagtgaatcttaccggatctgtcgcttctgtgaaaggagatgcgttggaacatcgtccggtagtggatgcaacacagagtttgcaaggtttagttccgggtttgtcagtaagcaatggaggatcgggacgtcctggcgctaccggttcgttgagtttgcgtggtcaaggcaacttgtctggaaattctgctccttatgtattggtagatggtgtggaaatgtctctttcagatgtaaacccgaatgacatcgagaatatttctgtattaaaagacgcggcggcttgtgctatttatggagcacgtgcagcttacggtgtgattctggtgacaactaaacaaggtgaagaaggaaagatgcgtgccagttatcaaggtacattaggatggagtgctccaactgtgctgccggatatggtgaattcacttgactttgtgaagttttggaatgacggtgtcagcaatacaggagctgctaaccgtatgtatagtgagcaaaaaatagctgatttggaacaatatatgagagatccgtccagtattgacccgtggggagatttggcaccgggtgaatcattgaatgccgcattcgaaaactcggaacgcggattgggaaatacggattattttgatctgcactataaaaattatagctttaagcataaccataatctcagttttagcgggggtagcaagaaagcacaatattatgtttccggaggctattataatgaggacggtattttgcgctatgctgatatggactatacacgctatacggttaatgccaatatcacttcagaattgactaaatggttgaaactgaaattcaacactaagtttatgcattcggataataggactccttttaataatgaagatccgaaaactggacttgacggtggtttgagtgaaggattttatcatagtttggcacgtttccgtcctacggtatcggttattgaccctaatggacattttacggaattgtctatgattccttatttgcagagtggaacgtatacagatacgcaacgtgaccgttttaatatcactgcaggttttgaattgcaaccgctgaaagactggtttattttctttgattatacttataagcaaatgaacttggagtatgaagcattgaatgtggctcccagtatttatgagcaagatggggtgacaatgaccaaagtggcgcgttctgaattgggagtagtggaagacggtaagtttacacgtacttatggacgtacccgttatcagactatcaatctttatacaaactaccagttcactctgaatgatcatcataactttacattaatgggggggtatcaagaagaggataatgattatagctatatgaagaactctattacaggcttgtattctacaaacaaccctaatttgggtatgggtacaggtgataaagtggtagtggatactcgtaacggatgggctacacgaggcttttttgggcgtatcaattatgactacgacggtcgctatctgttggaattgaacggtcgttatgatgggtcttctcgctttgctaaaggaaaccgctggggattcttcccttccgcatctttgggatggaatatttatcgggagaaatttatggaaccggcagccgatttcctttctaatttgaaattgcgtgtatcatatggtttgttaggtaatcaggcagatgccggtttatatacttttgcttccaatatgtcactgaatggtggtttgggaggatatatatttagcgacggtcgtcatatttataccaatcccgctcctgttattgacccgaatactacttgggagaaggtggaaagcaaaaatatcggattggattttggtttctttggaaacgctttgaccggaaccgtagatatattccagcgtgatacaaaagatatgttgggaccggggctggagtttcccgatatgtttggtgcggtagctccacaggctaataacgcccgtatgcgtaaccgtggttgggagttgtctttgaattatcgtggaaaaataggtaacgatattgattatagtgtcggagggtcggtttcagatgctgtttccgaagtgacggaatatgctaatgctaaaaagaatgatccttacggaagctggtatacaggccgtaaagtaggtgaaatatggggatatcgggccgaaggtctgattcagacacaagaagaagctgacgcttacaatgcggagtatgatttaagctatatcagtggaaaactgtgggaaccgggagatgtgaagtatatagatctggatggcaataaagtcattgacaggggagacaatagactggtagatggtgatatgggagaccagactataattggtaatacaaccccacgttatcagtacactttcaatggatatatcagctggaaaggattaagtctgagtgttatgttccagggtgtgggcaaacgtgactgggttgccggtggcgcatatttctggggatttggcccttatgctcaagttactgttttcaaggaacatatggattattggagaccggacaatccgggagcttattatccgaaaccttatattaattctgcgggtggagtagctccttatcaggataaaaatatacagcgtactgatttgtatttgcagaatgcagcttattgccggttgaagaatctgactttaagctatgacctgcctaattcatgggtacacaaagctggcttgcagaaagtgcaggtgttcttttccggagagaatctgttgacatttaccaaactgaaaggtatgtttgatccggaagccatttttagttccaactcatatacaagtgagggaggaaagaactatccgatgaaccgcgtattgtccttaggctttattgttaatttataattttgatatcttatgaaaaaaagaaatatattattggggctggctttggcattctgttttacggcttgctatgatttggataaaatgcccgagggagtattgtctacggccgaaccgtttcgcagtacaggcgaaataagaaactatatagaccgctattatgaatttggtgtccgtacgcaagggttcatggctggtggtggaggtggtattgccggtaatgatgttaacagtgataatttggcatctgctgctgtcaattcgcgcctgatgggattaacttcgttgagcaatgcggtggctttagataattatacacatattcgtaacattaattttttgataaataatgccggtgactgtccggaaaaaggcagtgtagagtataatcatctgatgggtgaggcctattatttccgtgcttggttttattattccatgttttcagactatggtcggttggcatgggtagacaccccgctagaaccaaatctggaagtaatgatgttgcctcgcgagagccgtacatttattgccgataagattttggcagatttggatatggctatttcactgatgaaggagcagaataattcgtcatccatgcgtctgcacaaggatgtagcccgtgcgttgaagagtgaagtcgctctctttgaggctacatgggaaaaatggcattatgctaaggaaaaaaacaaacccgaaaagttttatgatacggaacttggagaggcagagttaatggcaaagatagacaactatttggatcagtctatcgctgctgctgaagaagtgcgtcaacggggagtatggaaaatatataataccggaaatgtggagaatgattataggagcatttttgaaactcctgatctgactgctaatcctgaaattctttggtttaagatgtatgatggagatcaggtgggcaatagtgtcactcgttatttgaatacaggtggaggtaatgtgggggttacagcatctttagtagatgattatttgacgatagacggccggcctttggttgggaaagagcttcttgatgccaagcgtgtctatcctacggagttgcttcctactgtccgagacccccgtttgtcgcagactgtggccttgcctggacagcgcatgcaacctgctggggctggtaatccgtacgttgtcggtttcccctcgttggctggcgatggttcagcatttggaacgaacatgaccggttatgtgatgttgaaacatgtacagatagattatactggagattatatctcggaatataaaggctctactcctgccattcagttccgttacgctgatgttttgttgaattatgcggaagcgctggccgagaagaacggggcggctaatgcgggcaagattatagagatattgcatcctttgcgcgagcgtgccggtatgccggatattgatttcgaccgtgaatataatacttctgcggagtatccgtttagaaatctggataaatatatccaagctgtacgccgcgaacgccgggtggaaaaagcattggaaggtcgtcgggtatttgatatcatgcgctgggccgctgccgaggagttgattataggtaaccgcgcacatggtgctttgtttataggcagtaacttgccggaacaatacgggccagagttgaaatatgaccaggcatctggaaataatatgtttttgacaggcagccctgatgatgctgaacgttacatattaccggtgcctccttctacaatgccgaatggatggcagtttaaaccgaaccgggattatttgttgcctatccaggagcgtatgattaatgtaatggatggcatgtgggaacagaatcccggttggtaaggaagtgatgaatgaatccaaagttatataaaaatgaatagaataaccagtagtgtattgtattctttgacgggagcagcgatgttgtcatcgctgccttcctgcaaggtaaagaaagagagcgacgggaatgagaaaaaaagcatgaatattgtgtatatcatgtgtgatgaccattcttttcagactatcagtgcatatgaccaacgttatatgcagacacccaatattgaccggatagccaatgaaggggtccgtttcacaaatagttttgtggcaaactccctgagtggtcccagccgtgcctgtatgctgaccggtaaacatagtcatgccaatggatttacggataataccaccacatttgacggtaaccagcagactttcccgaaactgcttcaggctaatggctatcagactgctatgatcggtaaatggcatctggtatctgaacctaccggatttaattattgggacatcctgataggacaaggggattattataatccgaaatttattaaaaatggcgaacgggtacaacgggaaggctatgctaccaatattgtgacagatttggcaataaattggatggacagcatccgggacaagagtaaaccattctgtctttttattcatcataaggcgcctcatcgtacctggatgcctgatctttgtgaccttgacttgtatgatgatgtaacttatccgatgccagagaacttctatgataaatatgaaggcagaattcctgcatccaagcaggaaatgagcattataaaggatatggatttggtgtatgacctgaagatggcggacaaggagaatgagatccataccacaacgggactggaagaagcgggcagaaatatgtataatgctctgaatccggaacagaaggctgtttgggacaagcattatgatcctatcattgccaaattcaaacaggataagttaacgggtaaggctttggctgagtggaaatatcagcaatatatgcatgattatatgcgggttatccattccatagaccgtaatgtggggcgtgttttgaagtatttggaagagaacggattgatggaaaatacgatgattgtctatacttccgaccagggattctatatgggagaacatggttggtttgacaagcgtttcatgtacgaagagtctttccgtacccccttgctggtccgtttgccgggaggaaagaaaggtgatgttgatgagatggtgcaaaatattgattatggtcctactatattggaccttgcaggggtggaggtaccggcagatatgcatggagtttctttcttgcctttgctgaagggggagaaagtgcctgactggcgtaaatcattgtattatcatttttatgaatacccggctgaacatgctgtccgccgccattatggtgtacgtacagaacgttataaattgatgcatttttataatgacatagactgttgggaactatatgatttacaggaagatcctatggagatgcataatatctacggacaacctggaacggaagagttggttaaagaattgaagacggaattattacgtctccaagttcagtatgatgaccctattcgtaacatttacaaggattgacgacctaatctgacctaaatttaacatagcatgaagtattcccggtctttctgttttcaagaaggtcgggaatctttttttctataatcggacggactcattcccattgcatttttgaatacagtgctgaaattgcgtgaatgcttgaatcctgactgttctgctacttcgcttatggatagtgtggtggcatctagtaatttacgggcatattccaaacggcattttatgatgtattcactgatgcctatatccatcattcctttagtcttgttgtagagtgacgcacggctcattcccatttgctttgctatgaaattgacatccatatccacattgctgatattttcattgacaatgcggctgaattgaagcatcagctgctcattgatgtgattcagattttcttgtttgggtatagggatatctatggtggcatagtgctttttcacgatgttgtgattatgcatgatattctgtatctggatagaaagtaaatccatgtcaaacggtttggttatataggcttctgctcctgttttgtatccttcttctatactggcgtcatcgacacaggaagtaagcagtatcacaggcatatagtttaagtctggtttttgtttgatatagcggcatagttcaaatccgttcatgcggggcattttgacatcacttaatacaatttgggggcgttgtgacgtaaggataggaagagcttccatgccatcatgagcttcatacacttcttcaaacagaacttgtaggttgcaaatcaggtaattacataagtcgcgatcatcttccactattagaatagaatgaaatttctctatgttgtcttgttgaggttgtttgtaatcgatgtcggctgatagatgcaatgcatcattcaaataggtttgaggtgtagattgaatgtcggcggcttcctgtctatacggtaatgtgaaaaagaaagtcgctcctttggtttcattattttgggctccgatgatgcctccgtgcatttctaccagttgtttggcgtatgacaagccgattccgttaccttgaaagctatgtttaccctgatagaagcgagtgaataaattggctatatcttcttcttgaagacctattccctcatcttttatagttacccgtacacggcttccattaccttcgaggtaagtggaaacagtgacagtagaattttcttcgctgaatttataggcatttgtcaataggttgttaacgacgatttcacattgactgcagtcaaaatacatagtttctatggtagtgtcaggagtaaatgccaatgagatattacgtaacgaaagttcatccttgaaatcatttaggatactttgcaaccattcgttgaagggcgtggaagacatgcgcaggatatttttctctacttccatcttgcgcatattcagaatcatgtcaatgatgtttttcatttgtcgtgcttgcttgaacgcaccatatagtttgccacggagttcataggggatttgtttgctgtttgtaagttgtttcaacggtgtataaatcaaggttaaaggggtacgcagttcatggttgatattgatcaaagctttcactttttccttgtagatggtacgttcctgttccttgtatttccgtttcagttgacggtcgtgagcttttatggtatagataatgaaaagaatgatgatgaccgcacataataggatgaaccaggattgttgccaccacggaggaaggacagtgaattttagcaaagtgaattcagggctccagctaccatcgttctgtgtacattgaaccgttattttatagtcgcccggagaaatggtatgtaaaacaagatggggacgggatgtttctgtgtattctgtgttcagcccttttatgcggaaccggtagatgcgcttgtgaaatacatttcccccttccagttgtgtatgtatttttagggaggagaaattataaggaatttccatagttgatcgggggatgaagtgaactgttgtgccgttcaatgctatttcttgcaacttaagtgtgatgggaggtggagccgaagctggttttaaagctttgttgattcgtaccaatccctcggagccacccatgtatatgttgccgtcacttgccaccaatgcaggtttggctaaaaagtcgttaggtaatatgccgtccatctcattgtagatgacaaaatgatttttatgtggattataagcgtatatgattcccaatgaccccatccatacgatgccttcatggtcaatgactaaagaagtgattacgtcatttccatcgggtagctttaatggctctttacggtttgagggcaggtgaattctggtgactccattaggttcggctatccatagagtccctaaagaatcaatgcttgcagctaatatctggttatttctctcataagctatggtttcgtattcgtttttctctttgttgtattggaatacattgtttcggtcatgaaaaaatggataagtacggtattttccaatatagatccaagaatattgtaattgtttgttcttgaagtggatgggaataagttgttggcttccgggaatatatcggtaaaaagcattaccgtatagttctatttcgttccgatcattaactcgtatattggtgggtgcactggagcttgccagctttgcttctgcatctttgtccggaagagagaagtgctggtagtttcctgtctttttattgaagcggaagattccttttgaaaaactggatgctagcagttcggtttcggataaagggcaaatggatactattttttctcccaatgtttgcggatagtgggtaaaacgttccgtttgcgggtcaaagcagttgataccgcctccgtccgtaccaatccagatccgtccgtctttatcttcccataggcataaggggcatttgtcggacaagcctgaggctgggttttgtgcagctttggtataggtagtgataaaacctttttctgctcctagtacgccttcccgcaccatacctatccacatgtggttgttgctgtgacataggcatgtgactgaattggcagggaattgccggttttctttgtttgataagatttggatatcatgagtgtccggatagattatattcactccgccgccatctgttgccagccaaatggctttatcccactctgttatatcaagaacgatatcgttgctcaagtttgaattacgggtattataggaggtcagcagttgtccatcctgattataacattttactccttgcccgtagaaggagacccagtaacgtccggaggaatccttatatagatcgtatgcattggatgattcaccgaatggagaatcagttatttctcctgtatgtttatttaatagctttatttcccatgcattgtttattatcaggtaatgagtggagtcgaaaggctccatcttgataatatggattcctgttgtttttaaagggattgctttggaatgttttaattctttttcatatacaagcaatgtgtcggttacaggtatcagcagcttgcttccttcagttgttataatggaagcttttaccggctgattatgtcgcagaaaaatttgcagggaatctttctcatattcataataactgattccttgtgaggtgatcgcccatatccgttcttcattatctccgaaaatatcgttgatgtaatggctgtttttacgtaataaatacggtagattatatttcttgattttttctccattgaaacgatatattccttgagtggttccgacccataatgaaccgtttttgtcatcgtatagggatataatagaggttggaagtccttctttaatagaaagttgtttaaaatgataataaggacggttgatggaataagtctttatgataaaacaacatagaaccaggattacatagacggtttttctcattcagataaggtcttaaaacaaatatttgtacaaatataagaaataggttttgaaattcaaagcgaaaagaggatattgataaccgaatggctgtgatattatatataatttgtcattctgaacagatgtaaaagataacatagtgttcagaatgacaaaatagattgaaaaatgagggggatttgtctgactgtttttttgtccttataaggggatttttttcagtttttcattctcaaccattactttatatgtctttcctttagttgtcttaaaggtaaaagtcaggttaccatatctcagattgcagggctcaccggctttggacagaatgacggcttcttttaattttccatcctgccagataatgtcaatttcaaagttacctttggcacacagccccttgacagaaccttctttccatgcgtctggcaaggctgggagtaattggatgaatcccatgtgactttgcaacaacatttctgtgataccggcagttccgccaaagttaccgtcaatctggaaaggcggatgggtatcccataagttgtccaaagttccattttttagtaagttgccaaatagtttgtaggcgtggttgccgtcttgcagacgtgcccattgattcagtttccatcccatgctccagccggtagctccgtcaccgcggtgttctaaaacaactttggcggcattggttaattcgggagtagtaattggtgaaagggtgtggcccggatgcagtccgaataaatggttgacgtgacgatgctcgtctgtgggatcgtctatgtctgttgaccattccattaactgaccataacgtcctatttgatagggtacaagatgtttcagtacatattgccattgtttacggtctttggaatcgacacccagtgctttgctggcatcaatggcgttgagtaatatttcgcggattacagcatgtacaaaagtagctccttggtctacaggtccatgctcgggagaagtggaaggagcagcagtgtaggtcccgtccggtttatgccataaatagtctacagcaaagttggcactgctcttgataagatcatagcctacttctttcaggaattttttgtctcgggtgtaatcataatattcccaaatgtgagttgccagccagggacctgccatcgggttaaagttccaggacatattttcatcggtcaaaggggaagtaaatccgaaaatgtttccggatatggaggctgtccatccgcgtgcgccgaaataggcttgggctgttttttctcccggctttaccaaggtacggatgaagtctatcaaaggccatacacattcgttcagattggtggagcaagcaggccagtagttcatctggatattgatattattatggtaatctacatgccatgggccatctaccccgttggcccacattccttgcaggttggccgggagattgccggggcgtgaactggcaattaataagtatcgtccgaactgataatagatttcttccagccggtagtccggatttcctttgcgatagcgtgccagacgttgatgggtgggaagatctgtaacggcaggatattgcaaggtcataggagcatgagggttcagttgtagtttgactctgccaaacagttgggtatagtccgttttgtgtcgctcgcataattcgttgtaatttttggcagcggcagcgtctagcatggccagggttgtttggtccggatcaggaccgacatacgtcttggggtctttgaagtctggattgaagttgagtttataatcggtatctgcggtcagcagaaaaatgacttcatccgcattgcggacaatgaatttgccatcagtcgtgttcaggcttcctcctttgtttatggcttgtatgcggagagcaaatttcatttggttgtttttgaggcgaccggtatagagcaaacgattgggaccgtctgttttgatatcacctatggcttcagggttgctgccatagctgaatatcaggttttgcatgccgggacggtcggctgtgaacttcagtaccatcacgctgtcggggtaggaaacgaagtatttacgctcgtagttcacttcatctttgcgaaaactgactattgccatggccgagtcaagagacaggatgcgtttataatcggtcataccgatttcacttaaaccggtttcgatgtaagcttctcccaatgtagtaaaggagccgaagcgaaaaggtgtttcacggcttggctcataatcggccagtccgttgaagtttttgcaggtaagttcttctgcttttttctggttaccgtctgtgaatgcttggcggatttcgggtaacaggtgtgccgactctttatttaccttccaataataagctgctcccttttctgtgttcggtcctccgcgccatagtgtcttttcgtttaaagtgattcgttctgctgctatagatcccataacattgcctcccaaactgccgtttcctatggggagtgagttgttttcccatgctttgtctgttgcaggagaataccaggaagcgcgtccgtccaaattattaggggtatcaaaccagatgctcagtcctttggtgtaatctgtactctgtgcttgtaaggaagctgcgaataagcttcctaaaatgcatagttgaagtttcttcataaattaatgatattagttaaaggtatttctacaaaaatacaattagatttttatttgtgagaaatgtaatgtttgaaatttagggtgatttcctgtttttataggtatatcaaggttgaaagataattttcatcgaacatttcattggcgatatcccacagatgttctgctgtcagcatttctatccgtttgaatacttcttccgaaccttcaaatttaccatagtgcaagaacgtttttcccatatccaatgcattgttctcaaaattgtctccggcaactcctatttgtccgatgatctgtttttttgctgcactcagttgtgaggaacttagtttgctgtcacgcagttttttcaattctttatgaactagtccgatgcaacggtctgcatcttccggatcagttccgaaatagatgcagaacactcctgtgtctgtgtatgaagtcagattggcttctacgttatagaccagcccccggcgttcgcgcaaggaaacgttcagccggctgttcataccgggtcctcccagcagattgttcagcaggtaaagtccggttcgtttttcattatatgcattatatccccggctacctatcattacatgggcttgatgtgtttctttattcagtgtcaatgtcttaggaatatagagaaaaggttctgtccgttggcgttcggtaatggaaaaagggatgtcggctgtcactttctctatggtgcgtatcactttcttaaagtctatattgccttgaatgaaaaagatcatattggtagctttgtaaaaacgggaagtaaaattcaaggcgtgttcacttttgaaactacgcaataagtccggtttgcccaaaatattccttcccaaaggatgattgggaaaaatcaattcctcaaaatcatcaaaaatcagttctgacggactgtcttcataactttgtatttcatcaataatcacttccacttctttgtcaatctcatgttgtgggaaggtgctgtgaaatacaatatctgccagcagttctgctgcccgtgagaagtgttctaccagaaaagcactgtatatcactgtttcttccttattcgtatatgcatttaaatctccgcctacattttccatgcggttcaggatgtgccatgcatgtcttttttgtgttcctttaaagataaggtgttccacgaaatgggccattccctgttcctgttcgttttcatcacgggttccggcatcgacggcaaagccgcaataggctacattagactgattgggagcgtgaataatgcgcagcccgttaggcaaggtgaaagtattgtatgacattgttttttgcttcaaataagtttcggttggcaaaaatacaacaaaagttattgccgttcttcaaaaaatgcagatatttgtatttactaacagaaaacaagatgatggataaaattgctattttctgttccgcatccgagaatatagagcctgtgttttttgaaaaagcacgtgagttgggcgtttggatgggacaaaacaagaagacgttagtgtatggaggtgctaatatcggattgatggaatgtattgccaaggcagccaaagacaacggctcgatgataatgggagttattccgaccaagctggaagaacgtggacgagccagcgatttggtggatgtgactttccgtacagataatttgagtgaccgtaaagatgtgatgttgaatgaatcggatgtagtgatagctttgccgggaggagtgggtacactggatgaggtttttcatgtaatggcggccgctacgctggactatcatcgtaaaaaagtaattttttataatataaatggcttttggaatggcattatcgactttttggccggattggagaggcagcattttgcccatcatccgttgaacagttattttgctgttgccaatgacttgagagaactaaccgaactacttaaataatattcatgtaacctattatgatgacatctatacacgaattgttgcagaaagaggctcaggctgttttgaatattcctataactgatgcttatgagaaagcagtggaattgattgttgagcaaatacaccgtaaaaaaggaaagctggtgactaccggtatgggtaaggccggacagatagctatgaatatagctacgactttttgctctacaggtattccggcagtgtttttacatcccagcgaagctcaacatggggatttggggattttgcaggagaatgatttgctgcttctgatttctaattcaggaaaaacccgtgaaattgtggaactgacacaacttgcacataatttgaacccaaatttgaaatatattgttattaccggaaatgcggatagtccattggcccgggagtctgatatttgtttatgcaccgggcatcctgatgaagtgtgtgctttgggtatgacccccacaacttcaactacagttatgaccgtgataggtgatattttggtagtggaaaccatgaaaaagactggttttaccatcgaagagtatagcaaacgccatcatggagggtacttaggtgagcgttcacgcgagttaagtaagtaaaataaaatagaaccggaacgcaaaggacacaaataatacaaatagcattttattaaaggatttgtgtcatttgtgttccggttttatgtatataaatcgtaaatataaaaatgagaaaagtaataggtataggtgaaaccattctggatattctttttaaagatagccaacctacggcagctgttcccggtggctcggttttcaatggaattatttcattggggcgtttgggagtcaatgtaacttttatcagtgaaacgggaaatgacaaagtgggcgatatcattctgaagtttatgcgagagaatggagtaagcacagatcatgtgaacgtgtttcctgaaggaaagtcacctgtgtctttagcttttctgaatgaacagaatgatgctgaatatcttttttataaagattatccacggttgaggctggatgtgacaatgcctgaaatacatcgggatgacattgtgatgatcggctcttattatgctgtaacgcctcaattgcgtgataaggtgaaagaactgttggataaagctcgtgaaaaaggggctatcatttattatgacgtgaatttccgcagtactcacaagaacgaggcgataaagctgcttcctgttattcttgagaattttgaatatgctgatatcattcgcggctccgttgaggattttgagaatatgtttggtttgacagatgcggataaggtttataaaagtaagattgaattttattgtccgcattttatttgcacgcacggtggaagaggaattcgcctgtatacaaagaatataaaaaagcattatgaagtggatcctttgcagactgtcagtacggtgggagccggagataattttaacgccggagtagttttcggattgctaaaatatcgtatccgccgggatgatttggatgaactgtcggaagatgactgggaccatgtgattcgttgtggaaaggatttcagtgccgatgtttgtatgagtttgaataattcgatttcaaaagagtttgctgccggttacagataaatcggatagctctcattgttttaaactcttttattatgtatgagaacctttaaattaatagcaggtctttcctttttgctgctgatggttgcctgtcaggacaaaaagcggtcttcgcagattgaggtagcggagaatgaatcgaaatatgtggttttggcatatgtcacctcatggggagaaagtacgcctgatccggcatgtttgactcatattaattatgcgttcgggcatgttacagataatttcaaaggaatacgtatagataatgaaccacgtttgcaaatggtagtagggctgcgtgaaaaaaaaccgtctttgaaagttttgctgtccgtaggcgggtggggaagcagtcggtttagtgagatggcacagacagatagtacacgtatggcgtttgccgcagattgtaaacgggtgatagaccagtttgatttggacggaattgatatagattgggaatatcccggtataggaactgccggtgtatctttttcgccggaagatactgataacttttctttgttgatgaaggatatacgccatgctatcggtaaagacaaactgctgaccattgctacacaggcaggtgccaaatattacaacttaaaggctgtcgaaccttatgtggattatgtcaatatcatgacatacgatatggaggaatctcctaatcaccattcggccttgtaccgttcggaaatgactgaggaatggtcttgcgaggatgcggttgccgcccatgttgccgcaggttttcctgtcggacgcttggtattgggtattccgttctatgggcatgggactaatgaagctccagaattattggattatcgtcatattatcgttttggattctttacagagttgttgggatagtgcggcacaagttccttatatgataaattcgcaaggacatgtggtcgttaattatgagaatgcccagtccatcgcattcaagtgccagttcctgcatcagaaagggatgctgggggctatgtactgggactatgatagcgatgatgaaaagggtacattacgccatgctgtctatcaaggtgtaatgaatccttgattctttcagtttattttttcttatctgcatattttctgtaaagaggataagccgcttgcagtattttgttttttaataaaggcggatagtcgggataaaccgataaaaaagcttctacttctttgtaggccgcttcgctatcgtgattccttaataaagccccgacccaattgcgagggaaaaagatatctccggtgcgttgaacttctgtcagtttttccaatgccggacggatatatttcaccgcataatcttgtcttgtaggatgattcagatagcttaaggttgtagctgcccaaggctcaatccttctgttttccgcttgcaataaagatcggaataaactgtccaattttaaagtatcggcagtcatcgcacgtgatatgaaatcgaattggcgtagacggtccggattgtggatgcgttggcgttgtgtctgaagtatttcttttccttgctcaggtatgcgcaaggccagttcgtaggccaatgtagtgtaatctctttcatttaattgttggactctttcggtttcccataaggaatagaggcactgaatcatagtcggacttgctgcttctgtaatcagaaggcgtaataactggatgcgacaagaaggaatcggatgagaatggctgagtttataaagctcattttctattttatcacgttctgccgaagatatctcttgcagaggagaggacaggtaattggttaatgttgaagctatcaacgggttcttttcacaatgtattccgttgagtaatgcattcatccatgcagtattcggaattccttttgcttgataattttcatgcatcatcattaaaactgcctgtcgggttgtttcattgtctatttcttgccaatgttccagcagccaatggagactgttgttgtcaggaacaaacaaaccatatcctctcccgtccgtattgggcagaatacgggtgggggtaaagggtaacgtaatacggcataagctgtctgtcagactggcttctatcgttgtgtcccttgttccgcaaagggtgatattgaatttttgaggccagtttaatcctctttgatatggatcttgctgatgtatggtcaactgtttgtctgatatttcgaatttgattatcggcattcctttttggtttacccatacatcgctgaaagcggctagatcttgctctgttttactgtctagaatttgtatcaagtcatcccaagtagcgttggcgtaagcgtaagtttttaaatattcttgaatcccttcccgaaatgcttcttttcccattgattccaccagttttaccatcatgacaggagctttgttataaatgatctgtccataaattaatcctgcattttgaaggttatctagcggttgccggatagcagtggttccgggtgtacggtcttctgacaaggatgcggctgtataagtcttcatccaattcagctggtgattgacttgcgggaataatggttcggtaatcagagctgcaaaataattggcgaatacctctttagtccagacatcatcaaaccagttcatcgttactaaatctccgaaccacatgtgggcggtttcgtgggcgattaattgggttcggcgaagttcttcatccggagtgggattttcgcttaggaacatttgcgtgtcattatataaggtggcgcctgtgtgctccatacctccatattggaatcccggcaagataataaaatcgtatttggcaaaaggatagggaacattggtatattcttccagccagttcagcgaagcggtcacttgtttgaagatggtatctaattgagctacttttttagaatctgtttcgcggtaatatgctgagattttccggttaccttctatatattcttgatgttctaatttaccggtgacaaaggaaaaaagataagtgcttaatggttcagttggggcaaaagttactgttttgcagttgccttttgtttcttctttagtaatataggtattggaaacagctttccattctgttggtatatccagtcgtaaggaaaatgtggctttcagattcggctgttcgaaacaagggaataaggtacgggcacggtctggcactaatagcgtatacagaaattcatcatttctgtttagcgactggtttccggcaataaatttgatcgtgatattattttttccttctactatgtttttttcaggtaggatgatgtgctcgttatggaattcataacgggcagtttgtccattgacggataccgattttattttttcaggcttttctctgaagtcgagaataatttcttgcggtgcatccagattaaattcaatggtaatctctccatttaccggtactgatttctgttcaggaatggagaaatatagcttatacttcaactccttaatctcctgtttgcgcagtgttgccagttcttgcgatacgccctcgtcgtagaaacgaggattgcttgtggtctgttggcaactgcataataataagctgcacatgaaaataagatatccgatatatgttttcatcatctaaaatttatcttggttatctgcggcaatttttcggatgccgcgctgtgaagctatgaatgcacctcccaatactcgtttcccctcgtaaaaaacggctgattgtccgggagcgatggcggatgcttcggaaaggaaacggaccaatagttgtttttcatctaatacgagcacttgacacggaataggcttgctgcgatagcggatacgtactgacaagtccttgcattgcagtaaatcctgcatttctgtgatatgatagtcttctaccaacatatattctgctttaagttcctcggcatctcctaacatgactgtattcttttctgcattgatgcgtagtacgtatgctggatgccccaaagcgatttccaatcctttccgttggcctattgtataataaggaaagcctttgtgctgacctatcttgactcctttgctatttacaaaccatcccggtcctacttgggtgtcaatatccgggcattgcgaacgcagaaagtttcggtaatccccttctataaagcagatttccatactttcacctccacgggctttcgcttcgaatcctttttgtcggagatattcccgtacctcctgcttggtataagttcccagtggaaagagaaaacgttgaagtatctcctgaggaagtttccatagaaaataggattggtcttttgtctggtcatctcccgctactatatacagttttcccttccgttcttccagtctgcaataatgcccggtagagatatgggcgcaattcgtttggtctgcccattcacagagaattcgctctttgaatagcggattgcaaaggacacaaggattgggagttcttccttgcatatactcatctatgaagtgttttacaataatctgtttgaactcttccctcacatcagctacatggtgttctattcccaaccgttctgccaaggcccttgcttccagtacatcatcaggttcatcttgaccgggggtggaaaagcgggaagggacatcccacgttctcatggtaactcctaccacttcatatccttgttcttgcagcatgatgcacgtggcggagctgtctattccgccactcattcctaccaggactcttttatctctgttattcattatataaatagttcaggttcacggcgtgccgcacatttttggtgtagcatgggggtgtaaggagtatcaaaaactcgtgcaccattagggcattcttttacgcaagcgcagcacttgatgcatttggtaatctctgtttctatttttccttcatcgcttaaagcaatggcatgagtaggacatacttcgatgcattcgccacaggcgaagcattcttcagtgcagactggagcggcaggagtagaggggccaacaaagcgataaggtatgtttccttttaggtaaaaatcggataatgtttcatccttctccagttttgtcagacagtcttttccaaattgttccgcaatctgtaaatcggtaacatccggacggccttctgcaatgggcatattaggacggctgtagctgtgttcaccaataaaggcaccggcagccagtggggtgaatcccaattgaatagtttcatctctcaattcgaccagtgcatcttcgtaatcgcggttaccatatacagcgactaagatagccggagcattgttgccttttaatcttcgtagccgttgcaatgctattggggctaccctgcctgcatacacaggaactgcaatgatcgtgatagaatctttgatttctatcgggctactattctcatccgtagtgagatctatttctattcttctgcccatacctatactttctccgatggcacgggctattttcgcagacgtatgtgtaggcgaaaaaaatacgatgtgattgcttgtatatgttttcataaacgcaaatatagtgacttttgtccaaaggtagccaaatatatagataagatgtgtaaaggtgataaaaattgtctttatatgaatgtaaaaaatgattattaaatatctttttttctattttagttaatagaagtgatacggtaagctatattagttaaaatgtatttaggggtgaacaaaaaaaatcccatgtttagggagtttgaataattcttaattagaaaatgaatgacatatttatattggattattttgttcttttctggtttgttttgttgaataaagggataatttacaagttctggattccgctttatagagactaagctatattttgactgttataagtttaacttcttcggcgtacttatgctattatattaaggtgtatagtgaaagtaatgtcttgttttaataggtctatggggctttctatggttgtttgtaaggtaaagaatatagagatattcctatttcttaaaatattcctgtattttataaagatttttagtggaaagtcttgcagaatagagtaaaatgggtacttttgtccgatgaaattatggctattatagaaactgactaaaatatggatgctctatttcaaacgcaaagcaatgagctttctactacaacgcagaaagaaaagctgtttaaagatgcagaacggcagtggaatacactgtctaccgagaaaggagcgcccggaagaaaagttgattttgagatctataaaagcattttgtataacctagaaatcagaaaagtatatttggattcaaaactctctttagaaaagtttagttcaatagtcggcacgaatacgacctacctgagtaatgcggtgaacaactacttcggatgcaatttcaagcttccagctcgtggattagaattttgaacaattatttacgcaacttcgtgtcgcactttgatgtactgattgataattgcataggacttgcccgaaccgggcgtacccaagaccatcgtcgcacggaaggggttgacaaggttgatccatccgtcatacgccctgcccctgaaccagaagcgggtgcggaggttgacggaatattcgttctccttcaactcggtctcctgcatgaaggattcattctcgacgttgaacacatcttcgagcaggtcggtcttcagcagacgggacatccacagccctgccatgagcaggcagatataccctgcggtaagggtggcgatatacagcacggtgtccgccggaagcggcagaggaagggcgagcagccacccgttgccgaaaaagagcagcaagccggacacgccgcaaaggatgatcctgtgccacgtgattttctgctccttcacgccctttgtgccgaggcagctaagggcgaggaacagcacggcgaagagcttcgtccagaggatactggagaacagcccggcggtacgctggaagccgagcaatatcctattgaccacgccgatgtcgatgccccactcccggacggactggtaacagaaccaataaatatttaccactacaaataaaatgcttatcgcacgcatgaactccatgactttggcgagtccacgcaaatcgtcttcgttttgcataattcgttgaaaattaatgataaaacttcgttttattatgtacatgtactttttcttttccataaaacaggctgcatctcagcaattcaagtaaacttaattgcgttcgatttgcactgtttttgtcttgatacaaaagaaaaagataccaaaaagaaaaaatcaagactgcattttctcgctactccacttcgcaattttcggggacaaaaagaactcgctccgctcaaacagctttttgtccttatccgaaaatcgctgcgttccgctttacgctgcgaaaatgaggtcggtgtgccatgcggatgggcattgggcattgttactgttgccttccatatttgcgttttttcttcctttttcggggcggtacgggctggtcgccggacgctccgccgggtacgggggcaaagaggttgaaggcggccgccacgttttgggtgctgccgtccttgtggtcgggacgatagccggtatcgtgtccgtcccattgggatgcgcccgtatgctcctgctgccgggtgggatgttccactccggcggagggttgcggcagatgaataccttcctgcccggcgaaaaggtcgttgaacacgcctgcggagaactccttgcccagacgggagccgttgaagacggctttggcggcatggtcgatgaaggtcgccccatagatgcgcccggcttcattctgacggaataccacgccgataccctgccccatgagttcccgctcgaactgcgcccggtcatgccctgcggtctgcatggcggcggcaacctttccggcggtggcggcggcgacctccttgtgggtcttttcccatgcggcagcgttgtgcatccgcttttcgagggctgcgacgcccgcctccttgccgaacacggaggacttgaagggcttgccgaccttgttgccctccctgtcggttgccgaataggtcaagccgtgatactcccgcccgccgtattcccccttcacctcgtccaccgtgatgccgtaaagggaaaggacggcacggtattcgcccagtgtacggaaacgccattcccgggcaagcgggcggatgactcccgccaactgccccttgaggttgccgtccccgtaaccgacgggcgacaagggcagcccctctttccactgcttgggcgtagccgggacaagaccgaactgccgttccagctcccggcagaccttcatcgaacgcccgtgctcgtagctgtcggaaatcgcccgcccggtttcgtccacacggatggagacgatgtgcaggtgctcccgcccgatgtcgttgtggcgatagacgatatagggctggtcgccgaagcccatacgccgcatatactcctccgccaagctgacaaaccgctcttcgctcaagcaatccttcgggtcgggattgagggagatgtgcaggacgggcttctctgtcttgcggttggctgtgaggtagtcgccgaacgagcgggaaagatgccctatcgtgtaggggttatcgccctgcggctcgataatccggctggtgaaaagcacgtcggcgtgccgttcgtccaccttcaactggttgtaggcaagcaccccgtacaggctgctgccgtgcgagatcttggctatcatcggacggggtatttgctccggaactcctccaccagtgcggaaatccgcttgctcaactcgaccagttcgagggtgtgccgctccagtttgtagaggaaagcgagggctttcttctccgagaaattggatttgagtgcacgcacgcattggttgtagttcgtgcctatggcacggaactgcgagtggaaagtggtcaggcgcatgtagaaatcctgcgtccccttatccagtttaatgaccttaatctccctgccgaaaagtgcggaaacgataaactccgccttggtcgccttgcccgactcgtcgaaaagcgcgaggaaacgggcgttgtccccgtcgtccagacggaacacgtagcggtggcgcatcttgtcgggcttgggctttcgcccgtggttgcccgcatacttcttctgattgtccatcatcctgtaaaattttaagtgaaacatggtctgaaaacgccgtatgcctacggctctcccccgtgagcatcccccgactccggagggggatgccacatcgagggggcaaggtggtggtgaggcacgaaattcatttcgagtgccgcagcacacaacttgccattttcgtttgaaaataaaatccgtcctgtcggacagattggtgatgcccttgcctgttgcggagtgccggggcactccctcgggcggttgccgctctttttcattcttacttcattttggtttccgcctgcaaagtaacagcccttttcccgtccggacaccatacccggatgcgacaaacctacgggtggaaagacaatgcacgacacgttgataatcaaacggataaactatcggtattttgatattcctttgcgccgtggaagcggtgaaacgactgcccggatagacaaggaaacaaccggacagccgaacggacggacagccgaacggctgacggtcttgccggacaaacggacggatgattggctaaacagccaaacggctaaatgactaaacggctaaacggtcaaacggctgaacaaccggacaagcggacagccggatgccgggctgaatgtatgaccggatgcctgaacggatgaacggacggatgaatgaacggcagagtggctgaaaagctgaccgattgagtgaacagagaagcggctgcacgggcagccggatgaataaccaacagaatgacgatatggacagacagacattgaacgtggctttcgccacacagaaaggcggcagcggcaagacggctatcacggtgctggtggcgggctacctgcactaccgcttggggtgtccgctggcggtgatcgactgcgacttcccgcagtacagcctgtacgagatgcgggaacgggacagccgggcggtactggagaacgaatacctgaaacgggcggcttacgaacagatgcggcagccggggcgtgccgcctatccggtgcgcaagtgccgggtggagcaagccctcgacacggcaagggagctggcggcggaaggctgctacgacctgctcttcttcgacctgccgggcacggtgaactcggcgggcatcctgcgcacgatcgcacagatggactacatcttcgccccggtgagtgcggacaaggcggtattggagagcacgctctccttcctcgacgtgctgcaacggatgatgctgggcaaggaaacgagccgcctgaaggggctttaccttttctggaaccaagtcgataagcgggaaacgagcgggctgtacgagaagtacgggcaggtggtcgccgacatggggctgccgatgctgcaaacccgcatccccgacacgaaacgcttccgcaaagaggcggacggcacgggacggacggtgttccgctccacgctgctggctcccgacaggcggatgctggcaggcagcggcatccccgaactgacccgtgagatagcgaccatcctcaaactggaaggctatgaagaagcagcggaatgagaagcccatcgacgaggaactgctgatgcggatgatggcgggcgaggcggcaggaacggaagaaccgggaaccggaaaggaggaaaccgccgtgccggtggagaaggcgcaggaagggaagacggcggagacaagacggcgcaagggaaggcaggcggactacgagacgaccttccttaaaggcatggacatccccgcccgttacggcaagccggtctatgtgcgccgtgagtaccacgagcgcatcgccaaaatctcggtgatgctgacgggcggcaaggtgtcgctctcggcatacatcgacaacgtgctggcgcagcacttcgagcaataccgggaggagatcgaggcggcatacgccgggaaactggagaacctcttttaaaaaggaaggaggaaacggcatgatactgaaattatcgctcaccgtcctgctgctctattacctcgccgtgctgtggaaatactaccggcaggacatcgccgggatattcgggacagcggagacggacgaagacacggacggaacgggaaaggaaccggggcaaccgggcgagccgtacacggtcatgggagaaagcacctacctgcccttcggagcggaggacggggaggaagtagcagccggagccgtggacgaacccgcagcggaggacgacggggcggattactccgacatcgagccggaggaggacgaggaggagacggactatgaacccacgccggaggagatccgggaactggaggaggacgaggaattaggggcttattacccggacggcaaccccgacttcgccacggggtactccttcgatgacctgaaaaaggtgcaccgggtactggtgtcggacaatgcggacgaaaaggcggagcgggaagcccgtgaggtgctgccgtccgtgatggggtcggacatctgggaggcgatgctggacgagttcgagggcgcacgtgagcgtgtcgcccggctaatggacaaccataatgtttaattaaaattttaaagacaaatgagacaaaagagaatcttattcacggcggcctgcatactggctgccgtgggcgcaatggcgcagggaaacgggcaggcgggcatcacggaagccacgcagatggtcacctcgtattttgagccggggacgaaactgatttacgccatcggtgcggtggtcggcttgatcggaggggtgaaagtatatgggaagttcagctccggcgaccccgacacgtcgaagacggcggcgagctggttcggagcctgcatcttcctgatcgtggcggctaccatcctgcgttcgttcttcctgtaaaacagcggactatggacatggaaatcaacaaggggatcggcaggaacgtggagttcaaggggctggaaagccagtacctcttcatcttctgcggcggtctgctcgccgtgttcgtggtgttcgtcatcctgtacatggcgggcgtgaaccagtgggtgtgcatcggcttcggcgtggcttcggctacgctgctggtatggctgaccttccggctgaacgcccgctacggcacgcacgggctgatgaaggcagccgcccgcaggaggcatccgaggtacgtggtgaaccgcctgaaaatcccccgattatttatctttaaacactggcaagaatgaaaaacgtaatgaaagcggcgacgctcgaaagcaagttcccgctgctggcggtggagaacggctgcatcgtgagcaaggaggcggacgtgacggtcgccttcagggtggaactgccggaactgttctccgtcacggggagcgagtacgaggcgatccactcggcttggcacaaggcggtgaaggtgctgccggagtattccatcgtacacaagcaggacttcttcatcgaggagaagtaccggccggaaacggacagggacaacctgagcttcctgagccggagctttgagaggcacttcaacgaacgcccgttcctctcgcacacctgctatctgttcctgaccaagaccacgaaggtgcggagccgtcaggaaagcacgttctccaccctctgcaagggcaggcttgtccccaaggagatagaagaccgggagacggttacgaggttcctcgaagccgtcgggcagttcgagaagatcatgaacgacagcggtttcgttacgctgcgccgcctcacgacggacgagatcaccgggacggaaacggcggcgggcatcgtggagaagtacctctcgctctcgcagcacgacacgacggtgctgaaggacatccagttgaacccggaggagatgcgcatcggcgacgacatcctctgcctgcacaccctctcggacacggaagacctgccgggcaaagtggcgacggacagccgctacgagcggctctcgaccgaccgctcggactgccggctgtcgttcgccgccccggtgggcttgctgctggactgcaaccactgctacaaccagtacatcttcatcgacgaccacggggagaacctgaaacgcttcgagcagaccgcccggaacatgcactcgctctcccgctactcccgctccaaccagatcaacaaggcttggatcgaggaatacctgaacgaggcgcactcgaaagggctgacctcggtgcgctgccactgcaacgtgatggcatggagcgacgacagggaggaactcaggcgcatcaagaacgaggtgggcagccagctcgccctgatggagtgcaagccgaggcacaacacggtggacgtgcccacgctcttttgggcggcgataccgggcaacgagggggacttccccttcgaggagagcttctacacgttcatcccgcaagccctgtgcttcttcaccgaagagacgaactacaaggactcgctctcgcccttcggcatcaagatggtggacagaatgacgggcagaccgctgcatctggacatcagcgacctgccgatgaagaaaggggtgatctcgaaccgcaacaagtttgtcctcggtccgagcggaagcggcaagtcgttcttcatgaaccacctcgtgcgccagtattacgagcaaaacagccacatcgtgctgatcgacacgggcaactcgtaccaagggctgtgcgagctgatccaccgcaagaccaagggcgaggacgggatttactacacgtacacggaggagaagcccatcagcttcaaccccttcttcacggacgactacaagttcagcgtggagaagaaggacagcatcaagacgctgctgctggcactgtggaagggcgaggacgagaaaatcacgaagacggagagcggcgagctgggcagtgcggtgtcggcgtacatccgccggatacagcagaaccgggacatcgtcccctcgttcgacaccttctacgagtacatgctgaacgattaccggaaggagctggctgcaagggacatcaaggtgagccggaaggacttcaacatcgacaacttcctgaccacgctcaggcagtattacaagggcgggcgctatgacttcctgctgaactcgaacgagaacatcgacctgctgcacaagcggttcatcgtatttgaaattgacagtataaaagataatgccgagctgttccccgtggttacgatcatcatcatggaagccttcatcaacaagctgcgccgcctgaaaggggtgcggaagatgctgatctgcgaggaggcttggaaagccctttcctcgccgagtatgagtgaatatctgaagtacctctataaaaccgtcaggaaatatttcggcgaggcgattgtcgtcacgcaggaggtggacgacatcatctcgtcccccatcgtgaaggaggctatcatcaccaactcggactgcaagatcctgctcgaccagaagaagtacatgaacaagttcgacggcatccagtcgatgctcggtctgacggacaaggagaagtcgcagatactctccatcaacctcgccaaccatcccggacggaagtacaaggaggtgtggatcggtctgaacggtgtgcagtcggcggtgtatgccacggaggtatcggctgccgagtacctgacctataccaccgaggagagcgagaagacggaggtgttcgcactggcggaagagctgggcggggatttggagcttgccatcaagcggctggcggagacgaagtataaataatgtaccgatgtgctggcggtgagcggcggacaggctgccggacggatggttgattgaccggacgaacggctgaagggtcggatgattgaccaaacggctaaacggtcaaacggttaaacggttaaacagttaaacggttggctggctaaacggctggatgtacaaacggctaaacggaatggagagaataaaattttgtaaaacttaaaaaaacggaatcaagatgaaacgattgaatttaatcctgctgctgtcggcggtaacagtggcgctggcgtttgtcatttcctgcaaggagacaaatgcggaacggttggaaaagatgtgcggcgagtgggtcagcacgggcggcaagccgcccttcaccctctgggaagaggacggcaagtaccgtgtaacggtcatgcacagaaaccacaagggcggcagtgaagcggagacctacctcgtccgggaaacggaaggggtgctgttcatcgagacgggcttcgccgtaatgatggactatgaccgggagaaagaccgcatccggctgtcgccgggcggagagtacaggagaaagagtgacggaaccctaaaacagtaaggacatgagaacgataaaggcaatcattctgggcgtggcgtgcctgacggcaggtgcggccaacgcccaatgggtcgtacacgaccccggcaatctggcgcagggcatcatcaacacggctaaggagatggtggagacctccgccaccgcacagcacacgctggacggattcagggagacggcgaagatattcgagcaggggcggaagtattacgatgcgctcaaggcggtgcacgacgtggtgaaaggcggcgtgaaggtgaagaagtccatcgggctggtggcggacatctcggaaatctacgtgcgcaactaccagaagatgttaggcgacccgaactacacgccggacgagctggaaaccatctcgttcgggtacgccaagctgctgagcgagagtgcggacatcctgcaagacctgaagaacgtggtgaacgtgacggggatgtcgctctcggacgccgaacggctggcgatcatcgaccagagctacaagcggctgctggagtaccgcaacctcgtgcagtattacacggacaagaacatctcggtgagctacctgcgggcgaagaagaaaaaggacgccgaccgggtggtggctctctacggggatgcggaagaccgttactggtgacaccggcaatatataataatgttcacgtacataaatataatacaagactatgttgttagcgatagacttcacgaacctgcacgagatattgcaggtattgtatcaggacatgatgccgctctgcgagaagctgacgggtgtagccaagggaattgccgggctgggtgcgctgttctacgtagccgccaaggtgtggcaggcgctcgcccgtgccgaacccatcgacgtgtacccgttgctccgcccgttcgccatcgggctgtgcatcctcttcttccccaccttcgtcatcggtacgatcaacgcggtgctctcgcccgtggtgaagggctgccacgggatgctcgaatcacagaccttcgacatgaaccgataccgggagcagaaggagacgctggagagggaggcgttccgccgtgacccggagaaggcgtatctggcgagcaaggaggacttcgacaagaagctcgacgagctgggctggtcacccaaggacttgaagacgatggcggtgatgtacatcgaccggacggaatacaacatgaagcggaacatccggctgtggttccaagaactgctcgaactgctgttccagtcggctgcgctggtaatcgacacgatacggacgttcttcctgatcgccctctccatcctcggtccgatagcgttcgccctctcggtctatgacgggttccagagcacgctcacgcagtggataacgaggtacatctccatctacatgtggctgcccgtgagcgacctgttcagctcggtgctggcacgcatccaagtgctgatgctcacccgtgacatcgaggcgatgagcgacccgaccttcatcccggacagctcgaacacggtgtacatcatctttttaatcatcgggatattcgggtacttcaccatcccgacggtcgccaactggatcatcatggcgggcggggtgagccaagccaaccgtgcgatgaaccagaccgcaaacagggtcggcaacgtcgccgcagcgggtgcgggtgccgccgtggggaacatcgccggaaaaatcatcaagtagcggcggatgccccaagaaaatgagtcataacgaataaaaaaccggaaacatggaatttaaaagtttgaaaaatatcgaaacgagcttcaggcagatacggctcttcacgctggtattcgcctgcctgtgcgccgtggtgacgggcttcgccctgtggaagtcgtacagcttcgccgaggcgcagcggcagaagatctacgtgctggacaacggcaagagcctgatgctggcgctctcgcaggacgtgcggcagaaccgcccggtggaggcacgggagcacgtgcgccgcttccacgagctgttcttcacgctctcgcccgacaagtcggctatcgaggggaatatcaaacgctcgctgctgctggcggacaagagcgccttcaactactacaaggacctctcggaaaaggggtattacaaccggataatctcggggaacatcaaccagatgatagagatagacagcctgcggtgcgacttcgacaaatacccgtacagcgtgcggacattcgcccggcagatcatcctgagggaaagctccgttacggagcgcagccttgtaacccgctgtcgcctgctggatgcggtcaggagcgacaacaacccgcagggcttcatcatcgaggggttcgagatcacggagaacaaggatttgcagaccctcaaacgctgacggctatgataaggaaattcatcacaaaggcgcaggattgggcggacgggaagctccgccgcctcgccgggcgtatctcgcccgacatgcgtgtggcaatcattctcgtgatgctggcggcgttcggcgcactgtcggtctatatgaccgtctcctccatctaccgtatcggcaggaacgacgggaaggaactggggatagagcatatcaggcgcctgcaattgcccaatgacagtattatcaacccttttgaaagcggacggcatgggactggcggagaggttgagtgagtggctgctccgccgccgggagcggcaggaggagcggaacatgaggcaggtggcggcgtatttcgggagcctgctgaataagaggcgtgcggatgccggtgcaatcctccagtccgtcagggactaccgggactgcccggaggtaacaaggaaacaggcggagctgctgctggaacacaggttcttccggtacgtgtaccagacgggctatcccgaatggcgggcggtcatggacgccctgaaagagacccgttacgggatgcgtgagggggcggcaatcccccggagcgtgagggaggcggcggaaagcccgatgctgcgtctggaggcgcaatacaaggtgctggagtacgagtacacgaggcgcaacgccccgcagccgttatcccccgaagcgcaggcggaacgggatgcggcacaccggctgctgaactgctgcatgagggagggcgacctcgacgcactgaaaaggcttgccctgaaaggcgagaaaccggacgactcggtggccatccgccacgggctggcggaaggctaccacaggctcgaagaactgagccgggaatggagcgaggagatgcggggcgacaaccacaccgtcatggaacagatcgagttgcgggaggcggacgagaggggaaagctgatgcggcaagccgccgccctttacgagaggaagacgggcggcagactgcccggcgactatctggaagcggtgaaggcggaacgggcgctgctccacgggctcgcccgccacggctgggacggtcagcgggaagtaccgaaggagacggtggagaagtacgggctgacggaggactttgccggtatcgcccggctgaggtgggactaccacctgagcgaggacaacggggacttctcccgtgactacccggaagccgccatcggacgccacaaccgtgccatccgggagcgtgcggcgaaagaactggcaggtctggaagcgaggctgttccccgaaaaggcggcaagccgggaacggaaggctgcgcacctgcgggcggacaaccgggcaagccccacggcatcgctcaaacgggaacggaaggagccgcccggcaagcggcaaaccggggagacaggcagaaggaagcctccggggagaagaatcagaatgtaggacaaccataaatttttgacatgatggaagaacagaaccaagaaaaagcaacggcaacgcagcacgtgacggtggcggatgccgcagccccggagacggggaacggaaagaaggaggacaagggcggcgggaaaaaggagaagaagacagccaagccgctcacgccgaaacagttgcagcaacggaagaagctgatggtatatccgctgatgggcttgctgttcctcggctcgatgtggctgatattcgcaccttcggaggagcggggcgtgaaccgggacaccgtgggggcgttcaacgccgacatccccctgccggagaacgacgggatcatcggcgacaagcggaaagcctacgagcaggcgcaggcggagaaacagcaggcggagaaagtgcgctcgctggaggacttcgccttctccgaagagagcgatacggacggggtggaaatggaactgccggacagcgagccggaacgggaaccgttcagggactattcggacaatggcggcggcagccgttcctccgttaccgcctaccgggacatcaaccgtcagctcggctcgttttacgaggagccgaaggtggacggggaaaaggaggagctgaaaaggcaggtggaggagctgaccgccaagctggaagaaagggaacggcaggcgggcggaatcgacgatcaggtggcgctgatggagaagagctacgagcttgccgccaagtacatgggacagaacgggcgggacggcgcagccgtgcaggtacccgccaccggacaggacggcaacggtttgggacagcccgccgtggcggtgcaggcggcacgggagcggacggtatcggggctgcaacagcccctgagcgatgcggagttcatgcggcggtacagccagccgaggaactacggcttcaacacggcggtaggcagcgggtacgctatggggaagaacacgatacgggcgtgcatccacggggatcagacgattatggacggacagacggtgaagctccggctgctcgaaccgctgcaagcgggaaaccttgtgattccgcagaacacgctcgttgcgggtacgggaaaggtacagggggaacggctggatatcgtggtgtcgtccatcgaataccgggggaacttgctgcccgtggagctggcggtgtatgacagcgacgggcagaaaggcttgtctgtcccttcatcactggaacaggaagcggcaaaggaggcgatggcgaacatcggcggcgggttgggaacgagcatctcgttcgcacggagcgccggacagcaggtggcgatggacatcacccgtgggctgatgcagggcggcagccaataccttgccaagaagttccgcacggtaaaggttcacctgaaagcggggtatgagctgatgctttacgccaaacaacaatagatcgacagattataaaaccattaaaaagaaaggacaaatgaaaaagatttttggatgggtcgccctgcttatgggcatggtgacgggtgcgaacgcacaagtgaacgatacgatacagcggaccacgggcaacgacctgtatcaggggattacacggaagttaccctaccggcagatggttacaccccacggggtgcaggtgacgttcgccaagacggtgcatatcatcttcccctcggcggtacggtacgtggacttgggaagcgattggattatcgccgggaaagcggacggtgcggagaacgtgatccgggtaaaggcgaccaccgagggttttccgggggaaacgaacttttccgttatctgcgaggacgggagcttctattcgttcaatgcccggtatgcgcatgagccggagatgctgaacatcgagatgaaggattttttggagaacggggacacgacggacttctcccacacccggatgaacatctatttcagggaactggcaggcgaaagcccgctcttggtgaagctgatcatgcagagcatctacaaggaggacaggcgggagatccggcacttgggctgcaaacgcttcggggtgcagttcctcctgaaatccgtccactcgcacaacgggctgttctatttccacacggaaacgaggaacaggtcgaacgtggctttccggacggactttatccggttcaagatcgtcgacaagaaagtgccgaagcgcaccgccattcaggaacgggtcatcgacccggtgcgcagctacaacgaggtgctggtgacggatgggaaaagcgacgtgcgcacggtgtatgccgttccgcagttcaccataccggacgacaagctgctggtcatcgagctgttcgagaaggacggcggcaggcaccagaccatccgggtggagaacgccgacctcgtggcggcaaaacagattaacgaactgaaaatcaagtaagcgatgaaaaggttactgttcattatcctacttttcggggtgtgcctgactttcaaccgggcacacgcccaacggtgcctgcccggaatgaggggcatacagctcacgggcgggctgtcggacaacatgcgctggaaaaacggcgacggcttcggctaccacgccgggatagcggtgagcacctacacgaagaacgcccaccattgggtggtcggtgcggaatacttggagaagcggtacggctaccgggactgcctctatccggcgagccagttcacgggcgagggcggctattacctgaacttcctttccgaccggaagaagacatttttcgccgcactggggctgtccgcccttgccgggtacgagacggtgaactggggcgatagcctgctgccggacggctcccggctcacggatgaagacaatttcatctacgggggtgcgctgacgctggagctgtccgcctacgtgacggacaagattgtcttgctggtaaacggtcgccaacgggtgctgttcggcggcgactgcgggaagttccacacgcaggtcggcgtgggaatacgttttatgattcgataactgctatataatataataatgtatatatgaggacaatgatttataaaatactcacgggctgctacatcgtggccgccctcgtgctggtcgcagcctgtaatgacgggctggacattcagacgaaatacccgttcacggtggagacgatgcccgtcccgaaagagctgaaaataaacgagacggcggagatacggtgcgagctgaaacgggaaggacgctgggaggacacccggtacacgatccgctggttcctcttcgacggggaaggcacgctcaaactggaagacggtacggcgttgctgcccaatgaccgctacccgctggagaaagagacgttccggctctatttcaccccgctgtcggacgagcagagcagcttcaccgtctgggtggaggactcggacggtcaggctgtcgagctggaatacgacttcaatgcggacaacgacaaggaggacggggatggaagtggaactgagaaagagtgaggtaccggctttggcggaactgaaagacctgtgtcggcacgagtgtaccgcagagcggtgcgccgatgccgtcagggagttcggatggtcgctggagcatgtgccggaggacatgaaaaccccggagatgtgccgccgtgcgctggcagtgagtgcggaactcggttacgggcatctggcattgctgcaccatatcccgttcgcagaggtctgcatggaagccatacgggactggtacggcgagggcagagccgatctttacgaggtggcttcggcaatccgaccggaggtgttcgacgggaagatggcggattttctggtggcggaggacggcaggtgcctgtccctgctgcccgtccacctgcaaacgccggagcgggcggcgaaggcggtggaagtgtcgggggcgtccgccctactttccgaccgggtgaagccgggattgaaaacgccggagctgtggcggaaatgcgccgaacatagctggatgtcattcgtgatgattccgtggagggaacggtcgccggaagcgtgcctgacggcgtacctgaactatcccgggatgatccatgcccacccccatgtcgtgccgcaaccggtggacagctattgcaacgtgtactcgctgtgccgcctgatggagcagatgacgggcgggaaattcacctacggtcagatggcggacttctacgggggaaagccgatggcggtcaagtgcatcgaggtgcccgatggtttcctgaaagaccgtgaggtgactttcgaccggcagaaagagacgttccgcatcgcccctctcagccagcggcaggagcagaaggaacggcaagagccggaacggaacgacgcacccaagaggcgcaacggaatgaaaatatgaaacaacctatctaaaaaaacagaaacatggaacaagaagaaagaatgtatcaggtgcctttggagatgatatgcaggcacgaccgcacggcggaggtttgccgtgccgccgttgaagaggacggctggcagttggagaacgtgcccgaagaggtgaagacaccggaactgtgccggaaggcgctggaaacggaagcggggttcgggaacgaccgcttccggctggttcagcatatcccgtccccggaggtgtgcatggaggtgctgaaggagtgcagcaaggtctgcccggaggaactctacggggtggcggcaagcatccgcccggaggtgatgaacggcgaaatggcggacttcctgctgccgctggacggcaggtgcatcagcgtcctgcccgtgcacctgcaaacgcagaaacgggtgctggtggcggctgaaacgtcaggaatgtccgccatcgggcgtggcggagtgccgaaaagcctgctcacgcccgaagtgtatgtcaggtgcgccgcccacagccgggagtcgctgatgatgatcccgtgggcggaacgctcgccggaggtctgcctgatggcgacaacgaagttcccggactgggtgaggaaccacccggagttcgtgccggagagcgtgcataaccaagacagcgtatatacgctgaacagcctgatggaaagcctgacgggggaaaagttcagctaccggcaaatgacggacttctacaacgggaagccgctggaggtgaaacggatggagacgccggacggcgtgcagaaggacaaggcggtgaagttcgacaaggagacggggaagttctccttctccgacatccggcaggagcggaaacggggattgaagatgtagcatgaaccggacgaaatggaaagcatccttcgggatgcttttttcatatccgccctatcgtcttccggtttcttttgcttcttgttctttttccgccccgctcacgaaagaaaagaagtgcaaaacggatagcgaacaaaaaagggggtgcttaaagcatcccctcgtcggtgtagctgaggtaggtgtcctcggtcagtatgatgtggtccaaaaggcggatgccgattgcctcgcagcctttcttcaactggctggtcaggttgttgtcctgtgtgcttgccaccgtcgagccggacgggtggttgtgcgagaggatgattcccgaagcatgggaaacgagagccgtctggaggacgatgcgtatgtccacgaccgtacagtctatcccgctgcgtgagatgcacgaaacgcccagcagcttgcctgcccggttcaggtacatcgcccagcactcctcgtggtgctgcatacagtcctcgtagaaggtcttgaggatgtcgtaagactccttggaagagtggattttaactctcttggatgcgtcagcgtccttgtaacttacggtgatttgaggaaaagacagtgtattcataatgcaaaaattaaaagtgaaacatttattttttgctttggggcacggggaaagagcggacttcatgcaaggcttttgcgtggaatacgacccgaaggtgtggagattgtgcgcaaaaccgtcaggttcagccttgctacttgtccgtttttccccgtagatttgctaaaaaatgagtgtggagcttggctaaaaaatccggtgggtcaaggggtttctttttgcttctttgtctttgtccgcatccggctcaccgaaagaaaaagaagtgcgtccggaatgtcggggtggtcggggttgccacgggcgggtaaaaatagaagtccgggcggatcgctacccgtcccggacctgcggcgatgaaacacagaggggaatgttatggcttgatttcccccgttgcaattaaattcccgtccgaataatacgctatcttcccgtaggtaaatcccatgtcgggaatggctacgagagcgatatagtccgaatactccctgcctttgaggttcttcccgacaaggttgttgaatatcatggggatgctatgaccgtccccgctgtaaaggacggttttcccgttctgtctgatttcctgcttcattgttatcaaaatttgaaagttgaaaaatcggtttctttgctatctttctttttcgctacggctcacgaaagaaagtagcgggcggatttctccgccctgccctttgtccttaggctgcaatctcttcggtttgcggttcttcttcgggttgcgttaccttgcgctcccttgcccgttcctgcaccaagaggacggctttcttttcctcgatgcgctgatgccgcttctcgtacaccccgttgtactccctttcgatgttggcgagttcctccggcatgtgcctgcgtgcgaagtcaagcaagagggtcgccacggtgttgttgccgtatgctcccttgaaattggctacaaggaagtccctgcggatgatggtcttcatcctcacggtgaggttgccgataatccccatcttgtcctcgtccgtgatatactgcttgtcttccgtaatccccacggctgcgaagtgttccttacggagtgaagagagaaggaagaagtacaacatggtatcttcgtccgcactgaacttgccgcccgtgatgtcggcttcgaggatttgtttcttggtgtcctccaccgtgcgttcgagtgcgatttccttgttgcgctcgtcctgcttctccaatttctccacgggtgagagcggtgcgggtgcgggctttccgtccgctgtctgcgcttcggtcacgttctccacatagcagaagtcaatctccttctgcccgattttggcatagacggtgatttcccccgcttcgctcctgcgggtgatttcctcctcctgctccatgtagtccgcccattgctgctcgtagcgggtgcgggcttccccgtagcgttcggggtcgttgaaattttcggctttgggctctttcgggcagcttggaaaggcggtgtacctgtcaagggtctccacctcgtagcccgaagcgattagccgttctgccaccgtatcgttggtgcagtagcggtcacggcagagcgacacgcccggctgggtctgcatgatttgcacagcccgctccataaggtaggatgcgttcatttcggcaaggcacgtgcggttggcgcaatgcccgcacccgccatcacggaacagcagcaggttgttggtgttgtgtgcgcacgtggcgcactcggtcttgtcgaagcggtagtattgcaggtcggtggtgaagttctgttcgatgcgccttgcgacatcggcggctttcagtccccgccaactgttgtacgttccctcgtcctgcaaatgcttctcgtacacctcacgctgaatgtcctccccgtatcggcagatttcagccgccacgctgatggtcagctcgtccgcttccaaaagggcggcgatttcggggataagggcggtgaatttcagccgtgtgcggatgtagttctcgttctttccgaagagttgcgccaaggtctgcacggtatggcgtccgctttcgataagccgttgataggctgcggcttcctccacgggtgtcacgtcctttcgctgcaagttctcggtaatcgccatttcctcggcttcctcgtccgacaactcggttacgattgcgggaatttcgtccctgcccgcaatgacggacgcacggtaacggcgttccccgaaaacaatcccgtaacggtctgtcccgtcaacggggcgcacggtgatgggctgcaacacgccctgccgtttgatgctctcggcaagttcgtaaagggctgcttcatcgaaacgcttgcgtgggttgaaaccgctcggctgaatgtctgccaatgctaccatcgtgatgtttttctctgctgctgattgatttgcttttgtcttcataatctgttatttttaagttgattgtttatagttgttctttttgatttttgacaaaccgttccgttcgggaaatcggtttctttgctatctttctttccccgctccggctcacgaaagaaagtagcgggcggaaaatccgcccttacgggactacctgcggttatagcatacgttcgcgaacttctttttctgctctactgcccgtttgagggtgtagaacgtgccgcctatggctactgcatcgtaatagaccatcagaaaagcggagttttccaaaaggtagtcgttacggcgcaggaaacagccctcggtatatccgtcctgcaaggttaccacttcatcggcttgcgccaaaatggtgtcgtaacgctgcttgtcggcttgggtgtaccgttcggcttgtcccttgaaggggacaacgcatttcagacggatatgcgggtatctttttttgaggttcaatacttcctctgctgcgataaggtcgaagccctcgcacattcccgacaaaaaggtgtcgtagccttttttgatacaataactttcgatggctgcgaacgtgtcgaacgccacctccctgaagagtttctcacggtctgccgtgaacttggctatacggttggtgcggtgtcccgaaaaggctaccgtcttttccttgctaacgggtgttccgttttctgtcaatgtccttgtttccatatcggtaaattttagagtattaaaagaatgattatcagtacgaacacgaagccgacaaacagccgccacgcaagggcgaaaacaagccgtgccacgaagtaaaacagagccacgacaagcaacaaggcgaaaagctgccctgcggcggtggtaaggaaataagccgccgaagcccaaaggattaggcggtatatccgtttgtaaacaaatgccgttttcatgttcttgggtattgtcgggcggattgctccgcccgtggttctttaacagttcccttacgggatatagcggttatcagccaacagccggaacgtgtcgtaatcagccgttccccgataacttagggacagttcaaaggagaggtgtcctttttctatgtagaaagtgaagcgcaagccgttgcgggttatcgttcctttcgcatagtttctacgttcccagcttacgggttcgttctcgatacttttcaagaagtcggctacctttcgggcgttctccgcattttcctgctccacctgcctgtatatctgcgtgcagtagtttatccaatcgtttattttcttggcggtgaacacgccgatattgcacggcttttcgtattggctgcccgccctttcgatgtcgtagtggttgacgtattcaaagtgttccatgtcggcggctatcttgtacttgttctctttgtttatcttgtacacatgaaaacggatgccgttgtacgtgaactctatgcgcacgccgtaaaatgcggggtattcaccgcttaccacgtggtagccgtattccgcttggggcatgtacttccttatctcctgcatgagtggagacagctctttttttgcctgttccaccttctcggtaaacataacttttatgtttaacccgttaaattccttttccgataatgttttcatcgtcttatgtctttagtggggcggactgctccgcccgttggttgatactcttgttctttgctgtcccgtttaggctgctgcgggttcgttcatcggttcggttaccttgtcggcaatcatcttcgccgccttgttcacgtcccccaatatctccaccaaaaaggcgggttcttcctttagcttggtgagccagtgtttcagataggcggcgttgttctcctgcggtgcggctgcgtagccgaagaacgcaccgcaaagggctgcggtaagttcggcgacaagttcctcacgggcgtagagcgcatccccgaagaagctgccgaacgtgcggttcagccgttgggggcttcccgtgctgtgcgccatctcgtgcagaagtgtgccgtaatattccgctccctgcgggaactgctcacgctgcgggcaaacgatatggtcggaagagggcgaatagtaggcactgtccgaatactgcaccttgatggggcaataccaattttgcagacagacaagctcgtccaacgcctcgtaaatcatcccgtccgaatagtcttcgggctgctctccctttttcatgcgctcgtagcgttcggggtattttcctgcaaaatcggtctggtcgatgttgaagacattgtaatacttcatctgcgggatgaccttgtaattttcctgctcggctgcggtcagcttgcggtattcctcgtacttgattgtctttttcgtttccttgtgtaccacgaacttgaaccaataatagacggggaacgagcgtgcgcccttgcaaacacttaaatcctcttccttcgcttggttgaacgtgaggaacacgggcaaagtgaatttcataaactcggtgtagaacaataacatcaagacattgccgccgttatagagcgttcctctgatgttgcggggcaaaccttgttcaaggctcgctatccaaggtttttgccaatccgttttcaagcactcgattttcttgattaacaaatcggtgaacatcggtgcaatcttttcgatagtgctgttcgttgttgccataactcacaaattttaatcgttattactctgttttcatcgcttgtcgccccaaccaatttttttcccttggctgattgggaagaacattgaccatcattgaaagcggaaaaggtgaattgcaaccatctgaaaaaatggtaaatactacccgcagggtggagatttggcattttttgcggatttgctttcacctccgcctaccttcgtcaatgtttttccaatcagcttagggaaaaaatgccctgtcagtcatttcagccaatggtaagttacttgccgggtgcaggaaaaagaagccttccggagagccgggaacgcccgtttcccaaggcaaggagatacgggcgggagaagtatatgggaggacggtcaggttccggctgccggacaaacaccggggaactctttcgggcgggacggggcacgggaggtttcggcaaacagccgaagccccgtgtgacggcacggacggacgtgttccgtttgtccttccgcccgatgtccggcttcggccatgcagcctgccgaagtggtcggaaacggatgccgggacgggacagcccgtgcgccaaggtgcaagcgcaagaaagtgaaagccctttcacccacgttagggattgcagggaaaagcccacagcatagcgaggacttgcagcggaaagcccgacccgaaggggaacgcccaaacaaccacccgcaaaaactgcttttgagcataccttgaaaaaaagacgaccggacgctccgaagttttgtccttatgatatacatttgtaaatgagcgaaaatatacagtggaaaacgtatataactacatattataaacaatatgagaactataattatatcacttatactgttatttgtgtttcagaccgtatatagtcaaaaatattcatatacggacacggacattattgtttgtgatggagatagcacctatcttttcaaaaacatattatacccttccgtatcatattttatgagttgtgatagtttgaattctgatttggcttacatacattacgaaaattgggcatcttcaagaaaaacggagtcaatcttgcaaattaaatatgagaaagggagcctgtatgttataagtgagtttttacaaataaatatgtcccccgaaatagaaaagtacggaacagccccgatatttttgattaccggcaatcgtaaaatcaaatgtggcaatttaccgttgtcagatactggtattattgactggacgaaatatcacaactcaaaggaaaacgaaaaaaggtgcttggtatttgacaaaagaatgacattcaaaaaagaattgttctttaaccaaaaattggtatttgatgaaagacttttcaggctgataagtgatataaaattagaataagtttataataaatggctcaacctcccataaaggtcggttagccaccaaatattatatttagaatgaagaaacgggaatataaagaacaagaacgacaacggcgctattatttcttcgactatctgttctggttgggagaaatggcacagtggcattacaagggcgagccaagacgccccgacggggagtccatgctgatgctttgcagcattatatttatctatgagccgatcttccttacaaccgctcatttccttttcggctccacggtatttgagtggtttacagtcgccatgatagccggaagcgtcgcaagcctccactatctatcgaatggtcggatatacccgttttcacgaagggaagcggtcatgcagcactatgagggacgcaggttcagccccttcagatgttacttcttcctgttctccctcggctttctgattattgccgaaatgtacctgttgccaagcacactgatgcggatagacgggcgcaatgcggagccggtggagaacacacggacggaagtcccgcaaaggtggagggattaccttgcactgcatatcacggtaggagcccgtcaggaagtacccagcgaagccttgctatatctgatcgatcaggacagtcgcacatcccgatacgggcaaccggtctatgtcatgcaggtaagggaggaagatatgggaggaaagttccgtgcaggattgctgaaccacgccacctttgatgaaatccaagacggcagccggaaatttgtcgaatgtacatgggtcaagggatatacgccggacagcataagggtactgctgaccgggtggtatgaggtgagaaacgccgggctttgtccggtcgattctttggaatggacggaagatatggaattttgaataatcagtaacatacccaataaatagaatgaagaaatctatcatagcactgttgttggcggctgtatccgtcatgagttgcgagccgcccatgccgccgagcgacgaggaaatgatacgccactttgccacgcacgaggcggcgttccgcaaggtgtacgaaatcatgtcagagagttcagaaggcagtttccactacccgccgctttctccggaagaggtcattatacttgattcaacagagcaaagcgatacatcccatgaaacgaatgacgaagaagacctcccggtatatgggctgctgaagtcagaccgaatacagctcgattccttgttgtcagagattggatgcggtcttgtccttgttgaccgcagggaatgggaaacggcggattcggtatatgtgagcctcgttatgccgtactattcccacggcatcgtggatgcgggaacatccaagagtttcgtttacgatcccggattgagaagccgccggaacatccgtatcaccgaacacggcgacctgaacgagatctaccgaaggacatacaacgacaccacgttgtacaagcccgtcaaggaaggctggtacatcgagttagaccattcacgataacctgaaatgatgaacgcatgagagctttctcgccttattccttccgcccgtcctcgaaagcgatggtcttggcaaggaatatgccgatgacgaactttgccccatgcgctatcagcctgcgccgcagcgctatgaaagtagccccggtagtaagcatgttgtccacgagcaagacgcactttcccctgaaccgttcgggatggaactccagattggcggtgcggtctccgttcccgtgcgtgcccttgtattgcgcccggtcataagcgacggttatcgccccgtacccgtcggcaactcccatgtccgccgagagcttgcggcagaacgcctcgtaccgggtgcggtgcttctcccgtgtggatgccgggacgggaatcagcacggcacggtgcctgttctcctgaatcgcccggatgcggctggcggcgatggagaagagcttgacgaaaaggtcggtctgctcgccgctcttgaaacgccagacggcgttcgacaccttcttcccctcgaaggtgatcttgtcgttccgccggacggggcaatagtcataaaggtataaacacaagctgccgtccaagcggaagaaaccctgaaagcggttgtcgagcggaaagaacgccttgcggaagtcattgaagaaagtgaagacaaggatattgttccagaaacgtgcctcgtcctcgctgccggaatcgagcctgtacatgaagcccgccaagttcccgctctcgtacaagcccatgccgatggtcaggcggctgttgaagtcggtctggctgacgatgtaccagccgcaccgggcgaaatgctcctcgtagccggaacgggtctccagcaggaaatagaacttgccgtcgtcctcgaaacggatgacgtactcgcagcgcaggcggcgtgcaatcttgcccaagatgcggctctcctcttcgatgaccgcaggagtggcaaggaaggtgtattgagcgataaagacagcctcgtccatagtgatgatgtttgatcggttacaaatatgcgaaatgtccggcacacggcaagcggaaagggcggaaaatatgtggaagggcgtgcggatatgtagagcttctccctgcttttcaccgcccggaacgtgacaaggctacaaacgtgaagcaaaacgaggacaagcggtacggttttgatacacggacatatacagaccggtatatttgcagggaagtataaccataaaaacatatcgggacaatggaaatagtaagcatcgagaaaaagaccttcgaggagatgaaggaacggttcggcagcttctcgcagcacgtgagggagctttgcgcccgctaccgcccgcccgaaaagatgaactggatggacggggcggacgtgtgcgagaaattaggcatcagcaagcggacattgcagacctaccgtgaccgggggctgctgccgtacagccagatcaaccacaagatttactaccggacggaggacatggaggcgttcgtggaagccatgagccgggaaatgacggaggacgagtgagatggaagtgatcacaagggacacggaagaggtacgggcgtacttcgaggcactggaggaaagcatgaagtacctcgacacggtaacggcgcacttccgcccggcgatgaacggcgaggtctatctcacgggcgaggatgtgtgcaggctgctgcacatcacgccgagaacgttgcaggactaccgcacgcaacggctgatcccgtatatatcgctgccgggcaagacgctctaccgccagttggacctgctgcgtatgctggaggagaactacgtggacatgcgcccaaagcgcaaacgggggaaaagtccaacataaacgcacgggggtgtgcatcgggaaatgcagcaaaggcagggacaccgtatcggaagttcctgcctttgccgcattctgcaccggggaaaggcgtcaagccgtttcccggagggagcggcgcacccgcttcccgtcctgtttcctgtccttcttctccagcacgcttcgctgcatggcggcgaggttgccggagatcgcccggaaatcggagcttaccatcctgttggtcacttcggcgtagatctgggtcgtggaaatgtgcttgtgcccgagtatcttggagagcgcctcgatggtgccgccgttgcagagatagacggtcgtggcgaaggtgtggcggctcaggtggaagccgatctccttgtggatgccgcaggctttggctatctgtttgaggtgggtgttgcacgcgctgttgctgggcatggggaagacaaggtcgcctccggcaagccccctgtacctctctatcagctccttagcaatctccatgagggggacgttgctcgatacacgggtcttggtgcgccgggtgatgatccattcctcgccgtcgaagtccatgcgctgtatcttgtcatgggtgagcgtctttatgtcaatgtagctaagcccggtgaaacacccgaagaggaacatgtcccgcacgaggctggtctgtttcttgacgaacacggcgttagccaaggtgcgcagctcctcctccgtgagatagccccggtcggtctcctgcatctcaaggctgtactcgccgaaggggtcggtgcggacgattccacgccgccatgccttgtcggtcaggctgagcaggggcatggtgtatatccagagggtgttggcgctcagccctttctccacccgcaggtacttgtcgaaatcggtgatgatctccttggtcagctccttgtaagccatgtcggtgcgcttcttcttctcccaaaggaaggtcttgaaatggttgtaaacagccagatacttgttgtaggtggacttggctcgctgccctttctcgaccatcgccccgaactcccggttcatgttcccgaagtctttgaggatgcagttctccatcacgccgacaccgaggaaggcgttgcgcagcttctcggcggtaacgaaatcctcttcccggaggatgcggtggtagtggttggtgagccgggcggagatttcctttaattgcccgtttatctcgtttgcctcggcggacttgcctttcgccttgccgttctcccaaaggtcgggagtgacgaacagcttggttcccaccgccttgtcatctccgtcaacggagattttcaccatgataggggctttcccgtcccggtttctcactgcggatctcttgatgtagaacgaggtcgcaaacgtacttctctttgtttccataactctaaaattttcgtttctaaaggtagttacttatttcttaccaagagctatgcaaaacaaggcaaagcaatgaaacagaactcattatgccgtatataccccgtttcggaaccggtagctgtttagtagccgaactttgtccgaaaggggtgttttcaggctttttatgccgaagcctgcttcaacccgccctgcatacaagatgctgacctgcatttatttatgtagaactttgcttttctttgcgccttatgccgatttttttgaaaaaaagcccgccattgacgtaaagtttgtcaatgacggacaacttgctattttttgattttatttcgaactcacgttaatgtaatatttctgccattctttaatgctgacattaaagaagctgtttctttttcgcggtcacagaaatagtcgggtccttggtaaccggttattaaaaatggattagtagaaatactcttcattgcagtttttatgttacataaaacatgtaacgcaaataacgcaataaagtttggattgagcaaatataagagttgtatttttgttttgcccattatatcatgttctgacttgacatggttcatggcaacaatttaatatggcaattacaagatatctaaaacagaagttatgctgataatgatcatgtttcatggataagggcataaatacctggagcattatgatcctttgaaaagcatcaggaacagaaagcaggaagagggtatatagccggagccggctgttataccctcttcctgtaatgaggtagattccttatttcatcttatacaccaaagtcccacccttcaaaatatcttcatgcgagatataattctttgtatagggttcaccgttcagtgtgatgctgtcaatgtacttgtgttcctttgacaatccttcggcaatgatcgtgaaagtctttccgtcggccagattcaaaacgatttcaggcagctgcggagcgccgaagacataattgccacttaccggatctaccggatagaaccccatagccgagaacatataccatgctgacatctgtccgcagtcgtcattgccacagagtccgtcgggttcgggacgatattgcgtatcaaagatttcacggatcagttcctgggtacgttcggggcggcctgccaacgtatataaataagtaatgtgatggctgggttcgttgccgtgtgcatattgaccgatcaagccggtaacatctgcctgggtggtttccagtttcaaggtgaacaaagaatccaatttgtttaagaatgcctgttctccgccgaataactcaataagccccggcacatcatgttgcacatgccaggtgtactgccatgcattaccttcggtatagtctccaccggtactttccatgtgggcaacctgactagggttgaagggagatttccaacttccgtcagcattacggggacgcatgaactgcgtttctttatcaaacaggttcttataaaaatcggcacgtttggcaaaataagcggcatcttcctctttacccatacgttgggccatatcggctgcggcataatcgtcatataccgattccagtgtggaggatactgattctgtcttaatcaagtctgtagggaaataaccgtatttcatataagtttcccaatcggatttcagtttatgagatacggtctgggtatttttgatagcattgaaggcacgttcggcgtcaaaaccccggaaccctttgcggtacgcttcggcgataactgaaacaccgtggttgccaatcatggtatatgtctcttttccccaaagtccccagataggcaggaagccctgtacttcagcctgttctaccaatgaattgacgaatccgtctactttttcaggaaccattaaggtgtaaaacgggtgggcggcgcgataagtgtcccataaagagaaagtggaataaaaagctccgttaccggctttaacgatggaatcggctgcattacggtaccatccgtctacgtccgagatttggttgggctgtatcagggcatggtagaagctggtatagaagttggtcttctcgtcatccgtacccgttacttcaatgcggctcagataattgttccattcgttgtgggctgcttgcttcactccttcaaaattccagtcggctatttccgcttccatattcttcttggctccatccacgccggtggtggacatggctactttcatcagcagttcctctcccggcttcatgtcaaaagtagcgatgatgcgtttccctttttcagtttcggccatgggcagatacagggtatctatgacgggacgattgaacttcataacaaaaaagtaatcctggttcacccatacgctgttgcgtacatgtccggtcaaggtttgtgcatcttcccaattggtttcgcaactttgtacttgcgaatggtattggttttcgttccacgcaggtccgtgctgaaggtcaatcaatacagatgccgagtcggcgttatgataggtataacggtgcagggcggcatggggagaggcggtcagttcggccttcacgccggggtcggccagctctacggtgtagtatccgggagtcgctgcttccttgtctttggggaagtggctgcgataagcgtcccaggcacgggcgcgtgttccggtaaccggcatcaccaggatgtctcccaggtccatacaccctgttccattaaggtgtgtctgggtaaatccccatatcagggagtcggtgtacacatattccgaacaatatctccagccgacagctccggttacggggcttgtctggatcatgccgaaaggacggcaggcaccgggaaaggtatgtccgttgtctgctgctccgatgaacgtgttaacatactgcgtgtagtcagtttcgcctgtcttctgctgtgttgtggaacagccgaagagcgagcctgccaatacaaatgcgcaaaggatagaattggttttcttcatagattcgcaattaataaatattttgcgtaaagataaagagttttctggaaaaatgggtcaagaaatcaaaacaagaaacgaattaataagaagtaaatgaatatctttgcatctcttaaattaataaacgacatgaaaaaccttagtttgggatctctcatgaggatactctctgcattcattttccttttatcgaaccttctttagattaatccgaaatgtttcaacgcattggctattccgtcttcatctacggaggtggtcacatagtcggccacagcttttacatgaggttcggcgtttcccatagctatccctgtggctacgtgtttcagcatggggatatcattgccgccgtcaccgaaagccatggtgtctttcaggttgatgccgaaatattccagtaccttgtctattcccgtacttttactgttgccccgtgcaatgatgtcggcaaacaatggataccagcgcattggctcgcaatgggtcagcactttgccgaatatatctgtttctttttcctcttcggccgtaaagtaccccattatttgcaggatgtcttttccacgggcttcttctatggaggcgacagggggaacaggaatttcaatcagatcggaaacagcctgtactctgtcattcacttcagtgacgaacatttcattgccgtatgcaaaaacgaaaggtaccggatatttctgttgaaaagtgataagccgttcaatgtcttcttgcgggatgcaacctttataaatgggctggtggccggcggtaaaacaatagcttccgtttacggtgatatacccgtcaaactctaagtcacccaggttgtttattaaacattgtgggcgtccggtagcaataaatattttaatgcctttatcacgaagtgtctttaatgcttcttgggtcgaagcaggaatcttatgtgtttcaaaagaaaccagtgtaccgtcaatatcgaaaaaaatagctttaaccatacgtttgcctattgaatattatcgttatatattttcattttgcaaagatgagaattaaaatacatgcacacaaatacgataaaggttaatttttggcttatttgactttacagattgattttaatatctatatttgtgtttctaaaataacaagagaaatggcagttcagtttacaagaatagcagtaaagatcggtagtaatgtgttggcgcgtaaagacggtacgctggatgtgacgcgtatgtcggcattggtagaccaggtggcggaattgcgcaaagccggggtggaagtcattctgatttcatccggggcggtagcttcgggacgcagcgagatcaagccttccaagaaattggatagcgtggagcaaaggcagcttttctcggcggtgggccaggcaaaactgatcaaccggtactatgagctgtttcgcgaacacggtattcccgtcgggcaggtgctgactacgaaagaaagtttcggcacgcgccgtcattacctgaaccagcgcaactgtatgatggtgatgctggagaacggtgtcatacctatcgtaaatgagaatgataccatttcggtcaccgaactgatgtttacagacaatgacgagctttcgggaatgatcgcttccatgatggatatgcaggcgttaatcatactgagcaatattgacggcatatacaatggttctccttctacccccggtacgcaggtgatacgggaggtggagcagggaaaggatctttcggactatatacagacggagaaatcgggattcggccggggcggtatgctgaccaagactaccattgcccgtaaagtggccgatgagggcattaccgtcattatagccaacggcaagaaagaccatattctggtcgatttgctgcaacatccggcagagacggtttgtacgcgctttattccggcagaaggcggagtatccagcgtgaaaaagtggattgcccatagcgaaggctttgccaaaggcgagttgcatttgaacgaacaggccgtgaaagtgttgaaaggacagaaggcggtaagcctgcttcctgtgggagtggtccgcatagaaggggaatttgaaaaagatgatatagtgaaaatcatagaccaccggggcaggcagataggagtgggacgcatcggatttgattcggcagaagcgcgtgcattgcaggggaaacatggacagaaacctatggtacactatgattatttgtatttggactgatgcggtgtggtaatgatttagataaaatgaagtgactatggaacagataaaagatatttttaaacaggtgcggcaggcaaaaggatctcttgctttctgcaaggaggagatcatcaatgacaccttgtatgcattggccgacagggtggaggctgctacggaccggattctggaagagaacgccaaggatctggcagcgatggatccgtcgaatcccaaatatgaccgtctcaaactgacggcggaacgtattcacgccatagcccaaggcatacgacaggtagccacgctgccttctccatcgggaaggatactgagccaggccgtgcgtcccaatggcatgaagctgaccaaggtaagtgtgcctttcggggtgataggcattatttatgaagctcgtcctaatgtgactttggatgtgtttgcactttgtttcaaatccggcaacgcctgtatattaaagggggggagcgatgccgatttctccaaccgtatcctggtggagattatccggaataccttgctggatgtagcccacttgtctccttatctggtggcattgttgccggcaggacatgattcggccgacgcgctgctccatgcccgcggctatgtggatctgattattccccgcggcggcaaggggctgatagactatgtgcggcagaacgccacgattcccgttatcgagacaggagccggtgtgtgtcacgtttattttgacaaggagggtgatgtggcgaaaggagccgccattatccgcaacgccaagacacgccgtgtcagcgtgtgcaatgccttggactgtctgattgtagatgtgaaccggctgaccgatctttccactctttgtagcggcttgcagcaggacaacgtggaaatctatgccgatgacttgtgttacaattatctgaagacttcttacccttcccacttgctgaaacatgcttctacggatactttcggaacagagtttctggactacaaaatggcagtgacggcgactatgaccatacaggcggctgtggcccacatttctatttatggttcgggacatagtgaatgtattgtgacggagaatgaccgggcggccgattattttatgaagatggtggatgcggcttgtgtctatgtgaatgtgcctacttcgttcaccgatggaggtgagttcggactgggagcggaaataggtatcagcacgcagaagcttcacgcccgtggtccgatgggactggaggaactgaacacatacaagtggattattcagggggatggacaaataagacaataatactataaatgaaaaaattatgagatactttacaaacgtacacgatttgggcgacttgaagagtgcccttgccgaagctttcgaaatcaagaaagaccgctacaaatatgaaaccctgggaaagcataagacttgcctgctgattttcttcaacaacagtctgcgtacccgtttgagcacccagaaggcagcccgtaacttgggcatggatgtgattgtgcttgatgtgaaccaaggtgcatggaagctggaaactgagcgcggtgtcattatggatggcgacaagagtgaacatttactggaggctattccggtgatggcttcttattgtgatatcatcggtgtgcgttcgttcgctcattttgagaaccgcgaggatgattataccgaaaagattctgaatcagttcatcaagtattccggcaagcctgtattctccatggaagccgctaccggtcatccgttgcaggctttcgccgacctgattactatcgaggagtataagaagaaagaccgtcccaaggtggtcttgacttgggcgccgcatccgcgtgcattgcctcaggccgttcccaactcgtttgccgactggatgaacgaggccgatgtggattttgtcatcactcatcccgaaggctatgagctggacccgaagtttgtccgtggagcgaaggtggaatacaaccagatgaaagcctttgaaggggctgactttatctatgccaagaactgggcatgtcccggtgtcacccgtcctgccgactatggaaagatcctgagcaaggatatgaactggacggtagatgcagcgcacatggcagtgacaaacgatgctttctttatgcattgtctgccggtgagaagaaacatgattgtgaccgatgaggtgattgaagcgcctacttcgttggttattcctgaagcggccaaccgggaaatttctgctacagttgttttaaagagaatgctggaagggttggaataaccggcagtcggaatgacgtattcttccttttcaatttatcgtttcaccttagtgatgaaaccgtatcaccgtaagcattcggcctcgtgcgtgtttctctccaagttataataaagtcaaaagccatacttgtgctcaacaatagtaccgtcaaagtctactgctatggtcattgtatgtcaatatataattatatgttaactgagtttttttccgctataggttccagcaattctctagcaatggtaactttagcacatccaaggatatcaatttttacaaccagactagtagaaccatctatttcacgacatatattcccttccaaccctaccagtttgccaccgtttacacggacacgatcgcccaaatgcagagggcatgactcaatagtgacatgttcttcggcatcattgaccatacgcatcaagctgtacatctgatgatctggaataatagctacgggacggcaagtatttcgggaagaaccggctatgttaaccatgaaacgttttatataaggaaggcagactatttctttccgtcttactgaatctgtgcagcgaatgaacacaagagcagggaaaacaatacggtccacttttttacgtttaccatcatgacgaatactcatctcctgttggatagggacataaacttcataagctttctcactatcagtttcgtttttcaaacgttttcgtaatctatcctgacaggctttttcacttctgttatttacaacagccacataccaatgctttttttcctgatcatttcggaatatgcctacggcgtcgtcggtcttttgaaccgtcgttcccaaaatttgttgtggcatgtctttgcccttgttatttacaatactcatagtggaataatccgactaaaaacagacgcactcttatatagagagcgtccgatttcttaaatttctgatttccatttatgtagtaagttgtatgaataaaatcagcccataagtttattatatatagagagagaaaaaactttttttatcagtttacagtctgtaaatgctagaaaatgaaaataaatctatacctttgcagccgatagacgctctctatataagagtgcgtcctaatttcaaaataattcaaatattccccttcttatagatcttttaaaatatttctatttgcattatctatctgattagtctgtatagacgaaagatagatttgtgtagtagtttctgaatcatgccccatcgcttcgctaataataccaatcgagatgtttttcgtcttagctatacttgcccaggaatggcgcgccacatacatagtaagtggtgtggtcaatcctgcccgggctgcaatcttcttcagcttacggttcaccagcaacattttattccggtattgtctgcgctccgtgccatcttctcgttctataataggtaaaagatattgtgtttccgaatctccgtatctgtcaataatctcctgcatctgtttttcccaccgtataatgagtttcttacctgttttacgacggctataactcacaaagccactattgagatcttttttacgcaaataggcaagatctataaaagacattcctcgcatatagaaagaaaagagaaagatatctcgtgcaaattccaatgatttatgatcggaaagatccaactgcttgatgtgtttgatatctgtcagggtggcagctctctttgaggtcttgtccacaccagtatatacattctcaaaaggatctgcaggaagggccagtccctcacccactgccttgcgatacacacaacgcaaaatacgcatataaaaagaggtggtattacgacttaaatggtgagtggagcgcatctccgtttcataatgttccatcaaatctgcatccatctcatcaaaacataagtctatgccgtcacggaacttcatgaagctgttcaatgcggactgatatgtttcgactgtccgttcttttccttgccctctaagacgctctatctgctcctgcatgtattcaaaaacgaaaacgcccttactcggacggttctttaattttactaatctcatatttgccattacctaggttaattaaataaatcatcaaagaaaaatataatatcatgatttatattttaatgaggacttaaatacttgtaacggcaaatagattctttagaattaaagagaaagaactcagtgtgcttatatcgacaagtatataacaataaaaaatacaaaagcgcgcagctctgataaactgcacgcttttgcttattgtttattatctgtatccttatcggaattacttcacttcctcaaaatcaacagcatctctgtatgagcaacttgcgtgaacgtgttgcaaatatagtgcaaacccgaaaataagcatccataagcaaccacagctctttactgcaaaagtacagatttatttgataaatatcgtgatataaacacataataatcaaatcaatagggtaattttaacaaaatatgcaattcgaatacatactaatttaagaaatctttaagtgtaatagttgcaattcttagtccttttgcttttacttgtaagccattatcggaagttaaaagaataggattttcatttttaaatttaagtgccaccgttaatatgttattatctggagattttttattaaaatcatttggcaataaatcaggatcagaaagttccattgagacattcggcttatccattgctttattgatcaatcgcaaagccgtttctacattttttttgtttgccgcatcaagcttaattttaagtttgtccaactcgtctataacttttgcagacatgacaacttgataatgttcatcaatcttagaaataatatctggacaattaacaaacacattagtatcgatgatatatatattcttttgggtggttgacttaacagatttttgttttgaagtctcaaattttgagaggtctattttcccttttagatgcaaacttatcccgttaccttcaattatactatctttaagtttatttgaatactcatctattatttctggtataataccagaagttattttgattaagtacgaacgaacatctctatggcatgatgtattgagtattgatttatccgcaacaattattgttagttgttttgcacgacttgttgcaacattaaacagtgctctatcaagagacattccaatcattgtgttaggaatataataaatacaaacatcgcaagtcataccttgaactcgttcaactgtgtcgatgagaacattgtttttgctaccatatttacttataaaactattctgtaacattctaactgcagcacgaaattttgttaatactgcaatattcaatttaggataagatgataataaatcattaacaattctaatagtgaaatcacagctgcctttatctactttctcaccgataggcatctccttaggaataagaattgtaccaccttccttaggaatatagtgtatagtagtatttgctaactcatacttaaagtcagctaccgatttaataggtgtatgatagaaaatacttgtcaaatccgcagattttttcaataaacgatgtgtttctgttaaaataaacgacttgtagttaaagttctcacagagtgttgcaaaaccatttgcaagcatagcgaagtcattcctcataagcgtttcttcgcttaacaatacaattggctgcatctggttttgatcaccaatccatataacctttcttccaagatttttacatgcagctatcattccaaacaaagcctgacttgcttcatccataattacatagtcaaacggttgttcataataactttgtttagcccaaccgcttgtattatagaatgttgagagtgtaagattgccagaaatacatgttatttttttactatcaataggacaaagatttttgcaagtaataagttcatcagaagatacattagttttcattacccgcttatcggagaggtatttttttaggctgtccttttctgcaagttctatcagtgctctgttagtcatggcagtaacaagcacactactattttggctcagcaaatgtgcaacaagttcagccataagataagttttcccagtacctggagggccctgaaatatcagttgagaagtggattctaacgtcttgactatctcttcaacttgttctttatttgaattaatatgaataggattccatacaataaacttcttatcaaaatccaaaatgtccttggctaccatatttgtgtcgttgttgttaacgatatcaataaggttctgataataatccattggtggctcttgagggccaaggacaattacacatccttctttgttttctaggaatttagccatatctattgacaatccagtaaaaccacacagtaggaaaccattgtcatccgttttaccctgccagacacaatgtacttccgaaaattcgacttggtgacgacgcaagttaccccaactgatttctccccaataccttagaatactcatttctttttctaatacgactgcagtaaaatattcattcttgcgtggaattcctttatccttcttaaaacgaagtataagttgcccagatcccaatacgttacggtctgcattattggaatcagccatttgtaaatctagctttacaaactgtgtaacatacacttcattatctgttaataatgcaattgctttagaattgagtttctttagatattcttcacttattgctacaagttctttatcaagaaatctcttatgttgctctcttgtataatacattatatttttattctaaaagtcaaacaattcatctgtatcaatatttgtataaacatcagaaactgacatcttttcgtcaagtccaaaaccatttatttggtctgaaatagaatatgttatattttctataacgaagcatgtcttttttgagtacatatatctattagctagatatgcaaattctttaggagttatgatatccgtgtcaaatataaggttgacatccttattgtctttaaaagtatcattaaaacttatacgatgtatccttctatcatagccataattgagtagcaaattatctggatctatcattaattctgagaataatctaggatgaaggtatagctttcgtcctatagaactggttacgactacggttattaatttccctttaaatttaataatacctttaaccaaaccattccccaaattaggatcccatcctgagcaatcataatcctctaatgaatcaaggtaatcttttgcagcattacgtgcttccaaattcatctctatacgagattctttgtcaagattatcccggtcggaaacattgccgtaactttcttcatcctcataataatcaccgtctattctttttttactttttgtttcttcaagcattcgctcaagttctgctatgcgtttatccttttcttgaacaatatccgctgatacgagaaatatcatattccaatcctctttagaaaaaggacattttaataatgtagtattggagtatatatccgctagagaagatgctggttctctattcgctgatatatagatatgtctagtgtttgcaaaatatgtatattcacccgcataacctttaaataagtaagtattattataaatgcctctatacggaagttctccctcaattatgtatattgacattcttgaattctgtttccaatctaaatacaattgatttgaccattctgctgctttacagaaatcatcttcataatatgaaccagttagacgtaaagttttgtatagatttgacaatatatttacttggctttctgattctatcggaagttggaatgagttagctacccaattaaagaaagatcttattatgttagcatcattaagattccatatattctctaatttattctctttaaatgattttctccgcagtatctctttactttctttgtcatgcaacccaagttgaatcaagaattgttttttttcaaacgtattagcccagttctcaataaacgaaggcacttgttctattggtaaagtgaattcattactatcgaaatatgttccaactaatttatcaaaaggatattgaactcctccatttgtaataacaggacttaatatatctgcaatatctagtgccatactcttgtcaagtattttaatgaaaagattctgatcattagcacgaatgcatgattttagcatattatcgaaataattgtaaccacaaaactttctatacacaataagaaaacagaattgttctgcagtgattagttgagttgatgcagttagttctttatataactgatttcgaacatcagtaaggttaacttcccttcgagcaaatatcttttcgaatccatctatacttgaaaactttgaacttacattgctaagtatagaagatgatgaatatgctggtagtattttcgaaagcgagaatgtatagagttttacacctatgtttattgaaaaatcatctttaagattatattctgacaaactcttaccattaattgttattattgagcgtgcatgagaaacagccgtatcgttggataatgccatcttcatccatctatattcgaaagattttttgtcatattccaacgtacttaaaagtggcatagcttttatgctctttgcatatgctacctgagtattagtatcggattgctctacaatgcgaagtaaacttattgtaggtatattgctttttgaaaacaatgttatcgtaaatccgggtctccaatatgacaagaatgttttatgaatatctgaaatatctgtaatacttatcaagtcatcaatatatggttcaataatgcttgaataaatatctgttgatacaacaaggtatctagtaattaagctgttattttcttcttgctttaacatataatcatatagccaaaccggacaattggaattatacgcaaacattgaagataatggactatatttaccattctgatttttaaagattttccatttttttaatgtttcaaccccaatatttttaaattttgcaatattcacaaataaatgcaatctctcattaaatgtgagagaatctaaggattcttcctctattttttcaaaaattgctttttcatcttggctaacaataaacaatgataatgggtgttcttcaacagaatgattagaacatttaaaaccaagttttgataatactgactttatggttgaaatcttctctgttgaaaacaagagtttatcttctaacttaacttcatttgttgttttccactctttcccaaacataaacgtgggaacaagtggaattagagaatgcgctttttcttcttttgccaaccattcatagaaagatgtacgtaacttatcatcacaagaatcaataatccattttttaagggtatcaatattatttaatagaattgtgataacagtttctgtagtaatcttttctattccaaatatttcttttgacaatgaacttgaatcaatagattcatgaggtaaatgtttggttgtacctattagcttatagaaatcagatgcaccaattgcagaagatagtccagaagcatcaaatataatattatctggccctacgatatcattattatcattaagtataaatgctttatttgttaaagcatccttatatccacgattaaacgaatcgactagtgttgctgtatcctgactaaaataggtgagttcttttgttggaagtaaattaagataatttacattgagttcagaagcatagcttgaaaccatacttacaatttgctttccaatcatatagaacaagaagaaattccatggattgtcgctttgaattccttctctatcagacttgggaataaaatcagcattcaaataaaatgggaatttgaatctgtgctcattcataggaagataagcatataatgagagatcatcttcaccgattggcgtaacaagtccatcttcgtcaagcttgatagcaaatgagatagttgtttctttagccgatgcaatacggtctggaatacctgcaacttctgttaattcattaccatcttgatcaagtttaataaagtagttttctttttcacccctattattagttctttcttttcttctgatttgaatgcctgcctttttgaattcatcgtcattcactaaaagattatctgacgaataaatacaaaaatcttcaaataaacgatcttcattgaaagagtttacaagcgaaactatgttattctttctatctattttcttttgaatagtaagacatttatccttatctatcaattgcactcgattagtgtttctgagaaataacataaatcgtggttcagaaaacacttctttaatcgcctcatgatattcagaaagtgtttcttcatccatttttaatgcaatagcaacattttctttttgattgaaaatggaatcatatggatcaatttttaatgattcataccatatcggtaataactgccaaggaatatcctttacacctttgaattccctaaagaattttagatatttgtgaagaaattctttctgtttttccacatcattctcaatatcgttaacatggtagtaaaaggctttgaaatcattatagattggtaaatttttatcgaaagaaaaattgtagccagcacttttaattaatacagactcagaatttgtgaatactgacttgaacccaatacctttatagcctgttttcttactgcttgcactctttgtgctttttgcagcagatgtaattgattcaaagtcatgtttattaaatgcaaatccatcgtgtgttacaacaaaataattatcgctaagttgtaactttactttaacgccattctctggggcagcatcatcggcattttgaagaagttcaaaaaacattctctttttactagtatagaggttctgacctacttcttcaagcaagttagctacacttgtattagtgtttggacttgtatgttgcttaaaagaaagggaaacagactctttatatggattttctgcttctttaattttatttgatgatacacaaaacatataaggagaaccttgttccatgcggtattctttgcgtggcatgtcaatctctatctcataataattaccagaaacaaaaaaattacgcaatcggttatcaacgatggcaatgagacacttcccattaattggatctactagtaatttgccattgttttcttctttaacatctcctgtagacattaaatttgtgaaaaaatacttggaattaatctctataactttgccaataaaacgattggttgttaatcccatagtagccagtaaatctgtaagactaagttcgtaaaggctctcttcgtatttatcttcaacaaaaaactttctactaaaaatcagctggccgttgtcttctcccatatatgcaacacggacatgttctcctggaaaaacttcatcactagcacgaataactttatttggtgacagttcatccctatatatactgcctaagattccggtattaccaatgtctatagtagcaaatttattgtttatattcttaacaatagcatcaatgatatcgcccttatttagttgagaacgtaaccaatcaactctagctttcttttcctcggcctcgattggacgcatatccaagacaacatcttttaacttttcattatatttaatgaaaacaaattcaagttcttcatcagtctctatttcattgttcaatagtctggttttataaggttcaacaaaacgttttaaaggtacaattacctttatcaatccatctgcttcaataagagcagatgtggaattttcatttttaatgatacccttaaataaacattttacccgttcattctcactatgtacttttgcaaaataatcatgtaaagccaacacactcatcgaaattttgtttcgatgcttctctgggtcgtaattgttgtcaattacaacacaagtaatttcttcaccttctttgtattctattgttgggagttcacttacatgaacaagtgccgtgctgtctcctaagtttacaataagaccgaaactctcaacagattttataataaccttgtatatggtacctttttcaactgttcttggattgggtagaagattttttcggcttagattcaactttccatctggtaattctttgataacttttacatcaagaacatcaccttccgataatgaagaaagagtcacagactgattagaccaagatatatcatgaagtcttatcaaaccgtcaactccattgggcatttttgcaaatgctccgagatctggttttatactggtaatttttacgcgaataatatcaccaactgatggattattatatgttgtcataagcaatttatcttttagtataactttacaattttgttagtcactctgatctcaaatatttcaattaaaaattaaatcagatataagacattatctatcattcacatattagaatctaacacatgtaacattatagtttcatgcaaagagaatttcttaattacaaaaataggtattttatcattttaaatagaatacaaacacataatagtcaaatcaatgggctgattttaacaaaatatccggttttatccttacctttgtgtatgatattgggatattatacccgaacaacaataaagaaactatgcagatacataacaatacattgataacagaatgctcggcttacgatttcaaggaaatgttggagcgtaagaaagtgaagtcgtggcttaaatccgtgtcggctttcgctaatacggatggtggcagtttgttctatggagtgaatgatgacggcgtaattgtagggttggagaatccacaagccgatgctgattttatcagtgaaatgataaaggcaagacttgaccctgttccggaagttcaacttattccgatagaacacgaagagcataccctgcttgaagtgaaagtaaagacaggaacgcttacaccttattattactatcaggatgggacacgtaccgcatatgtacgagttggcaatgaaagtgtagaatgcaactcccaacaattactttcgttggtattaaaaggcacgcacatgacttgggattcactgcctaccgaagtggatgccagcaaacattctttcatcatccttgccaatactttccgtgaacaaacccatcaggaatggaatgacaagtatttggaatcattcggactggtaactcctgacggcaaactgaccaatgcaggattgctgtttgtggacaattgcacagtatttcaatcgcgtattttctgcacccgttggactggactatataaggatgatgccatcagttccgtggaacatcgggctaaccttgtgctgctcttaaaatatggtatggatttcatcaaaaactataccatgagtggctgggtgaagatgccaaactatcgccttaacctccccgactattccgaccgcgccatcttcgaaggattggtaaaccaccttatccatcgagattacaccatgatgggcggtgaagtacatattgacatttacgatgaccgagtagaactagtatcacctggtgccatgcttgacggcacacagattcaagaccgtgacatatacaaagtgccgtccatgcgccgcaaccctgtcattgcagatatgttcacacaattggactatatggagaaacgtggttccggcttacgcaaaatgcgagagcttacagagaagctacccaatttcctacaaggcaaagaaccacaatatcaaacggaagcgacttctttctacaccacattctataatctgaactggggtgacaatggaagaatacctgttgaggaagtggctaacagggtaaacagtaccctcgaaaagtaccctgaaaacgaagaaagttcggtggaaacctttggtgatacgcaagaaagttcggagaaaggttcggagataatcccaaaaggttcggagaaaaagttcggagattcgaaaaacaaatctaaaagcattgggaaaaccacacaaaagattattgatttcgtcatttccgacccatcaatgtctgcagaagcaatggcctataaaataggaataagctcccgagccgtagaaaaacatatttcaaagcttcgttctatgggaattttgtctcgtgaaggagcagatcatggtggctattggcgcattattgttaaccctcaaactgagcaataaaactatggagacatctttcataccattcagtgtaataattgccgttttgattatcgcctttttgtttgcctctttgccacaggtaaaccataaaacgcgatacaaagtactttatgcaatagccatcatcatgttattagctgttatccctattagtgaatatatggctggtggcatacaaaactcaagtaacaattatctgcttgtcctaatattcgatattgcagtaggatatttctgtatgtatattgccgctttactgaagttcaatgttcttaaacgaaagaaccaagcattagaaaacgccttgacagaaaagcaacaagaaaatgtagcaatcctattggagcatcaaaacgaaaaacaacaagcacttcagcaaagagagcttgaatggttagctgggaaaataaagatgtttaccgaaaaagaacaggaagctattcttgccagtgctctatcatttgctgaacatgacttgatagttgctccctcaataagcatacagcccaaagaaacatgtagtcagcaagaactaatgtactttgtctgctctgctttttacaatatggataaaagtcgtagtgaagttgtgggtttcttatataaagtttttcctctctattttccagcaggagaaagtgcattggctaaaaagatgccgggattggaaaaggtaaaagaaagaagggaaaaagaaaacactcagaaataaatatctaaattatcaagaacatggataatgttaaaaaatatactcattctaactttttcacaaatagagacaacaataccctcataaaagaatttgagggcatactacaccataatcctcatatttgtaatcttgatgcagttgtcggttttctcagagcatcaggatatttttctttacgtcctttcctagacaacataaataaggttagggtcttaataggaataaatgtagataaatacattgcacaagcaacaaggcaaggaaagatattttttggagcagaagaagaagtaaaagaagagtgtctacgtgaaattcgccgagatatagagcattcgcattatagcaaagaggtcgaaaatggaatgttccaaatggtgaaagaccttattgatggtaaattggaactaagagcgcatccttcaaaaaaaatacatgccaaaatatacgtactttatccaaacgattttaatcaatacacccaaggaatggctataactggttccagtaatcttactggaaacggactaggcatcacggaggaacgtcagtatgagtttaatgtaaaaatggatagatatgatgatgtaaaatttgccaaagaagaatttgaattattatggaaagaagccgaaggatgcgaaattacggctgatgatgtaaaaacatcaatagatcatacatacctcaaaggtgatgcttcaccttatgacctttatattaaaatgctcatggagtatttttcggatagagtcatggcaacagacgataacaatccatttgatatgccggaagggtataagaaatatgattaccaaatggatgctgtggaagaaggttatcaaaagctactgcgttacgatggcttttttcttgctgatgttgtaggtcttggcaagactgtaattgctacaatgatagctaagaaattcttgatcgagaatgggcgtgacaaaacaaaaattctcgtcgtctatccacctgccgtagaacacaactggaaagcaacatttaaagattttggcattgacaagtatgttaattttatttccaatggcagtttgtctaagattctcgatgaagacaattataactactggaatgctgatgaatttgaccttattttggttgatgaagcacataaattccgctcgcatacaacctctgcctttgagcaattgcaggaaatatgcaaaatgccccgtatagaaaatggaaatattcccggctttaagaaaaaggtaatgcttatttcagcaacacctatgaataatacacctgcagatatatacacagaaatccaattattccaagatccacgccgatgtacgattgatggtgtatcaaatttaacggcattcttttcacctcttattaaagaatttaaacagctaaaaagagagccaaatttcgacataagtcgattcaagaaattagcagaacgagttcgagaccgcgttatcaagccattgacggttcggcgtacacgtactgacatcgagaacgtgcctcgatataataaggatgtgaatggctttccaaaagtagagcgtcctatagaaagtcgatatgagcttaatgagcatctcgctgatttgtttgaacatgctatgcttactcttgaaaagaacttgacgtacgctcgttatcaagctatagcctacttgaagcctgaagtggcacaaggactgtatgataacgcggaattaataagccgcagcttagctggaatccgtaaaaacggattggtgaagcggctagaaagcagtttttatgctttccaagtttcattagacaatttccgtcaagcaaaccaaaatatgatagatatgtttgaccgcaacaaagtattcattgctccggatcttgatatcaatatgctattagaatcagggttgagtgatgaagaaattgaggagaaactaaatgccaaagcggaagataatcccaaaaatgcagtattcactgctgatgattttaagcctgaatttatagaaatgcttagaggagatcagaatacacttgaaatgttatgttcagaatgggcagatataaaagacgaagatgattccaagttcacaaagttcaatgagctgcttaagcataagttgttcaaatcggaacgcaatcctgaacagaaactggttgtattttcagaatcagttgacacagtagagtatttggcacgccgtattaatcgtaaagacgtattggtaatctccgctgataatcgtagtaagcagttcaaaactatccgtgagaattttgatgctaactataagacaaaactcaatgactacaatatcatcctcaccacagatgtgcttgctgaaggtgtaaacttgcatcgagcaaatgtgattgtaaattatgacactccttggaatagcacccgactgatgcaacgtattggtcgcgtcaatcgtatcggttcttcatccaaacatatatacaattacgttttctatccatcccgtgaaggaaaccgtgaaatcaatctaaatcaaatcgcattaagtaagattcaaacctttcattccaccttcggtgaagacaaccaaatttactcacaagaagaaattcttgaccgcgacttaagtaaactctttgatgaaggcatgaagaaacaaaaggaagaatgtaatcaagaattgccatattatgaggaactccgtgcactctatcaaaacaaccgtagagaatataatcgcatagcaaaactctcattgcgtagccgtactggtcgtgaaatgaaaaaagtagatggagtaacacttgcaaatgacactcttgtattcctgaaaacgaatttccgtaaggtattctttttggtctcagaaacagcagaagaactttctgtgcttgatgctctaaaatatttcaaagctcccaaagaagaacaatccgcagagcgtatagagcaacaccataagcatattaatatggctttacgaaaatttcgcatgatgcaggatgaagaagcacgttctcaagaaactacccatgaagaacaaggttctgttggagtgcaagttagtaccgctgtaaatttgttaaataatttcattcgtgaaatagacgataatgaactatacataaaagtagttcagctcaaaacattagcggaaagaggtgtcatcacctacatagctaaacgcttacaacgcatacagaaaaacttgcgtcgcgtaggaggtaaagccagaatgacacatgatgaagcacttgcagaaatcattgatatggcaaaaaagtatgcaccatattatacggcacaagaatctctgcttaatgagcaagagactaatgcagaaattattttatcagaatcattcaataaactctaaaaatagcaatatgaactacaaagaagtcatcgaatctaaatataatcgtgaggcttggcaaaaattgctttatgatatattccgaaacaaaattagtttttggaacactccttctgcggtccacgtaagtagccgcttagctaaagaagcattgaatcttggcaaaatatctcttgtagatggagaatctatagccatatacgaagtggaattgagtgacaaagttgacattgagcgtaaccgtcgtggcattcgtgatatgctcactacagattggcgtaatatggggtatgctggagcatttatgttctgttatcgtaaggatgaaagcattcttagattctcatacgtaagtgaaacttgggggtttaacaaacaaggcgaatatgaaaagatgtcaactaatacaaaacgctatacatatttgcttggcgaaggtcgtggatgccgtactgccatagaacagtttggcacattgaaaaatagcaaacagacactcagtgacataacgaatgcattttctgtcgagacactcacaaagcagttctacaaggatttattcgaatggtatcaatgggctatagaaccatcatctaatgtttcttttcccaataatacgggaactgaagatgatgaccgtgaggatttagaaacaaaagtaattcgacttattacccgtattatgttcgtatggttcatcaagcagaaggacttggtaccacaacggatattcgatattgattatttgcagactatcctaaaagagtttgacccatatagtcagactgttggaaactattacaatgcaattctccagaacttgttctttgcaacacttaaccgtgctattgaagatgaacaaggaaacaaacgcaagttcgctaccaatataaagaaagatatcaaaaccctctatcgctatgccgaaatgtttaacatcagcgagaatgatgtcgttaccttattctcagaagtccccttccttaatggtggactctttgaatgccttgataagaccaagacgattgacggtgttgaacaggcctacaattatgatggcttcagtcgcaacgacaaacgttttgctgatgggcgctatcgcaatcgtgccattatccctaacaatctgttcttcgattcagagaaaggactgatttcaatcctcagccgctacaactttacaatagaggaaaattcacccgaagaacagcaggtagcccttgacccagaattgttaggtaaagtatttgagaatctattaggcgcatacaaccccgaaacaaaggaaacagcgcgaaatcaaagtggttcgttctatacgccccgtgaaatagtcaattacatggtagacgaaagtctcattacctatttaggagatactcaatttgtacgttccttattcaatccagatttcacccttgacagagaaaaaccagaagaatatcagcgtgtcgctaaaagattaaaggctatcaaaatacttgacccggcttgtggttctggagcattcccgatgggattgcttaatcgcatgatagatgtgctctgtcgtatttctccaaatgagaaagtgtatgacttgaaattggcaatcatagaaaattgcatctatggcagcgacattcagagtatcgcagcccaaataacaaaactacgcttttttatctcactgatttgcgattgtgaaaaagatgcttctaaaccaaactttggcataccgacattaccaaacctcgaaacaaagtttgtcgctgccaattctttgattgctaaaaagaagcaagcttcacactgtttatttgagaatccggatattgagccaacaaaacagaaattgatagaagtccgtcatgaacatttttctgcaaaaactgctaaccgcaaaagtaccttacgagaaaaggacaaggtattacgtgaaaaattagctagattactggcggatgacaaagactttgcccctgaagatgctatacaattggcagcatggaatccttatgaccaaaatacagtagcagagttcttcgatcctgcttggatgtttggagtcagcgatggcttcgatatagtaataggtaaccctccatacatccagttacaaaataatggtggtgaattggctaaactctatgaaccatgtgactataaaacattcgcaaaaacgggagacatatattgccttttctacgaacgtggatggcaattactgaaacccaaaggtcatctttgttatatcacgtccaacaaatggatgcgtgccggatacggagaaaaaacacgtggattctttgctaagaatacaaatccccaattgcttatagacttcgcaggcgtgaaaatatttgagagtgctacagttgatacaaacatcttactcttttctaaagaagataacaagcataaaactttatgcactgtcaccaataaacaaaataaagatggcgttaagaatttgagcgttttcgtgcagcatagcggagcggtgtgtgatttttcttcttccgattcatgggttatcctatctcctatcgagcaaagcatcaagcggaagatagaagccgtaggaacacctttgaaggattgggatattcaaatcaactatggaataaagacaggttataatgatgcttttatcattgatacggaaaaacgtgaagcgatattggcgaattgccagacggaagaagaacgcaaaagaacggctgaacttatacgaccgattttgcgtggcagagatattaggagatacgggtataaatgggctgaattatggattatcaacattcataatggtataaaaggtaaattacctcgcatcaaaatcgaagagtatcctgccataaaagctcatttagatttatattgggataaaatatcgaaaagaacagacaaaggagatacgccatataaccttcgtaactgtgcttatatggaggattttatgcggccaaaaataatatggaagcgtatagggtcaatacttcgcttctcgtatgacactacgggtaattttggtcttgatagtacctgctttgccacagggcaacacatggcttatttgtgctgcatattaaattctcttatggggcattatatgttcaaagattctcccaagactggtactggagacttgcttgtaagcgtacaagccattgaacctattttgataccgatgaataaagatatggaatgcttgtttgaaaatttactggaagaggtcttgaaacatcgctcggaagaaacagaaaaggaaataaaccgtttagctttcaaactatacgatttatctcctgctgaaatcaactacatcactgattttgttactcaatctcaacaaagccaataacttgtcgttctttctctgatagattatataagtcgaaaatcatggaatctattgccatggctttcgacttgctatatacattctgaatatcattaacagcagacctgaatcgtgcattcatttcgtctgtcacctgcattactggaattttgtcaaaaaaaattttgctcatttcacgagttccaccttgtagttctggaaatgaatcacggaagcagaacttgaacaaagaagaattgaagaatgcagtaagatatgctatagcttgacctgttataatgaaacacttttgatttgtacaataagcattgtcatcatatacgaacggcatatattttgtcatgttgggatagacaatttttggcttattaaaatcctcccaatagctgatgctgtcttgtgtttcaaaccacttattgtgagtcttcttgcgagccttgattttttcgccgttgatagaataggtcttgcctgtctgctccagtctttctttgccaaatgaaagaagatgtcgctttacggcagggtacagctctatgtcgtagtgacgtgatggaaatgtggctatgaggtacttgtcagcccactcatattcatacctcctaatatctctgccacgcaaaatcggtcgtataagttcagctgttcttttgcgttcttcttccgtctggcaattcgccaatatcgcttcacgtttttccgtatcaatgataaaagcatcattataaccagtaagcacacctcgatagatatttatatcccaatctttaagtggagttccaaccgcttcaatcttctgtttgatactctgttcaatgggagacaatatcacccacggggtagagcctgtaaagtcgcactccacgccttgttgctgcacgaaaacgctctgtttcattccgtcaaaaactgttttataaaacggtcaagcgtatttctatcaactttacataatttagaaattttacgcttagaaacttttgcctttaaaagttcatgaataagattttcttttccatgaagtttatatttttctacagaactttttcttccctttggtcgtcccaatgtcacaccttcagctttttttcttgccaaagcctccttcgtgcgctggctaataagattacgttcaatctcagcagatagtccaaaagcaaaggcaagaaccttactttggatatcatcaccaagacgatagttgtcttttatagtccacacacgacattctttggtcatacaaatatttaatatctccataatcatgaatagatttcttcccaatcgtgataattctgcacagataatgagatcatctttctgaatctgtagtaaaagcctacccaattcacgtttattgtatgatttcataccactaatggtttcctcaatccaaccatcaattacaagtttataacgttcacagaaattattaatttcaaaacgctgattctctactgtctgcttatcgctgcttactctaatgtatccgtaaatcataattttattttttattatttatactttatagaatatcccataataacaagaaaaatccttttagccatattctataagaatataaaagaataaatccttaataagcagtattttttatatgcaacaaatgctatttctttattttgagtttctccatttttttaatataagttcagattgttcctttacagcccgatacatcgaataatacgcaaagctttcttccttatacttcatactgctaacagaagcagtaatagcccatgtaacaatagcgacaataaagaccacaacatactggagttttatatgatgcccacgtataaacatcccattaatattgggtggaataatggttactggatttttcaattcattgatttttgcaagtatctcatcctgccgttttaatatgcaatccgtatttgcttcaatagtcatacgattgagattgtaatcgcaaacgtgccgataaagatattcaagaagtttggacttctgcttgaataattcaatgagtttcgggaaccatagtgaaaatggtaaagtgttcggctgttgtttccaaatatgtttctttaccacagacaaggcttcattccaacaagtgcagaaacctttagcgactccattataaatgatcttttcgtcaaagtccacttttacagattgttccgatttagaaacagtggcattctgtttttcaatacattcttttagctcactgatactttgacgcaaatttgcaagattcgcagctactacatcttctttcattatcttctacgttttgagggtttatagaaaggttcgtttctttggctatccttgtttttatcgtctcgccatccttgttcattgcttgttcctccacctccactggaagttatggcctgatggggttgaataatcaattctgtagttacattgcccaacgtaacgcaaaggctgttaaaactcaaatcacagtcaagtttagaacctgcaatgctaaattcatccatacaaaaggatataccacgaattttatcagagttctcagcatgattaaaacgcatatctatgccctgacctttgagaatgccaagaaaatcattccatgagcgagatacagccagtgcatcaagagctgcagaacgtagattatacttccgtaattgatgaggacgtaaacggctcttatttctggctttgctgtttttaagggcaaagtaaagtttatattctttggttaaagctcgacagacttttgcatttcgtatccgttcgttgctatcagaaatgagattaccgtcattatctatccgattgaacactatatggcaatgtggatgttccgtatcatgatgcctggctatgatatattgggtattgctaatccccatctgctccatccatttcttggcaatctccaccataagtgtatctcctttttcatcatcggaaaaacggatggtatcttgcggagagaaagcaagtgatacgtgtttcaccgaactttttactttcggacgcatagaagcttgtatctgaaaagaatcggctatggtcttattgctgatggcacagacaccttcgtatgctaaaagtatggcactctttttcttgttcttttgatcattggcgtaatttactatccctccaaaatcggctcttgttttaatcttcgctatcatgattgttattctttacttgggtgataattctactgacttctgatataatagaaaaacattgttgtttcacggcttccaaaccatagatgtgcatctgatgggcaatctggttgacattattggctataccggaaaggtcacggattgccgataccatttccggactgatacgctgaccaacttcacagcccattgcagcctgatggcaaaattcattgacagacagtccagcctgttgggctttggattggatatagatatagtcgttctcggtaaacattacccggaaacatttcgtgcgtttctggtaattcgctaactttgggcgaccaccaagtttctttttcttcatacttatctaaactttgatgtgcataaattgattttttaagagtggcagttctatccgcttgccgcctaggttttagtgacactaaaacacaaacttgccactcaaaaaatcttcctatatttaccttgttctattcggcttagtttgccatctttgataaaggcctctatccacttgtttgccgtacttccattctcgcccaaagttaaaaccgccgcatcataatctttctttgtgaaagtgtcaggcaacatattataaagggtgttccttcgtgcataaacgcccgtctcttgcgaagcggcattgaatcgcttagactgatttcctgacaaattctgataaatgaatacggcatgataaagcagggtgtcgcaaatactcatggctatggaatagtcaaactcatggcaaaccaattgtacagtctcgtcagaagaagatttgtgaatcacattatccaaatgtcggacagcagtcaacaccatcattatacgataagcaatcagtcccatccgtctgactactccttgcatcttgttatccacttcgtcacaacattcctcattcacccgactgagatattcaataaagtgttcctgcaaatcagagggaagagaaaaggaataattaccctgccgtacaaaattctcatgcaaatggcagaatttatctcccaacagtttgaacatggcattcttggattgagaaatgtcgcttgtggcaaacacatttcttatacctcgtttgaagcggataatatagaaacaaaagcgactcatcaatccgttctccgcatcaggaattaatcttcttacctgttctggagttccagccaaagctaccgaaactctcggattagctacttcgcaatactccctgtccttacggcgacttaaacttaccagctcatgatgaaatgcctttcgcaacacatcggaataattgccgtaatccgactttaaagtctggcttaacgtgtcaccttccgattcaaacaacagcccgattccgtcattgtcccccaatatcttcaagaaagaacttgcgctactattggcaggaatgacgagcatacgcatgggcggttctgttggcatagtcatttcatcagttttcttacctttgatataagcgctcatcgcttctttgtattcctgttccatccgctttgaaagttcatgcaaattacggttaatgggagctaccaattctcggcataaggtcaatgctccttttcccataccggcatctgccaccacgaacagatatagattcggataaacaatgcgttcatcgtacacgccacaaacattatgaaagcataccgacaaacacacaatagccccgattaatatcgtatcacggtcatctactgaaatggaattattgacaacctcatttagaaaaggaggaagatgctcaaacacacattcaggaaatacaggaagttcttcttctgattttatccatttacccgtttttccattttggatatttggtaaaatggataaatgctctttactgaacggagccaatgagattccggcttgatttgccaaatggaagaaagagcggatagtaatgccttgtcctttggagtgcagacaatacgtatattgtttgtccgttttttcccttttataggcagggtaaaacctgctgatgcggtgataatactcccgtccgttttctcccaatccatccacaagcgcaaagcccaactccacccaatctttataactggatgctatatcaatggcacgctgctctatctcccgaacaacacattccacatcttcctttaccttattatatataagggtaatacttggtgtatgtgcctgttgtatttcagaagggacattctcccaatcttgggcggaaaagattttcttcgacatcatttttgtatttatggttaatatatgcttgtgggtcgtagggtaagaagcatgaacgagccacatcactgccggacatatccactaatggcaaacctgtcgctttgatgcagttggcaacagccttgaagtaccgggaatgtttccagcctttcaagtcaacaggtattatccacttcaatccattaccggatggactgacaaataacagttccgtatcaaaatactcatggttgagtaattgttgttttaactccccaatgttcttcacatgatcgaaatccaaacacatcaatcctgagtgcataatcagttccttttcattccgtttccggaataatcccgaaaaagtacaatagtcaaaatgggtggctttgtaccttttggcttcgggagaggactgcatctgccgaaggttctcggtttgtggttgggcataatgtccgatgatataacgatacgcatccacaatacctatagccctcatcggttcgatgttttgaatgggcttgcgaaagaatgaaaaacaatagtctgtcatttccatcatctgataatctttttagattcgacaaattgtttggcttcttccattaagtcatcctgtgtcttatgcgatttgttcttcaaccaatcgtcaatctcagattgcagaaaagccaacgctttatttattttatgtacgggaatctgtttggttgatacccatccataaaccgtttgcttggctggatgcgatggtagataagcgcaaagctcgtctatatccatccacttgggtgaattacttgcctgcttatgctgcaaggcatttactttggtttgtagtacttctacggactcaatcaagtaggacaacgcattcggcatctcctctaacgaatttactttataagccattttcttcgtatttaagttaataccgcaaaagtatagggatgcttataggtgctaaataggtgcttgaccgccaccaatcaaccgttcatttaccactaacagatttaagtttcattaatacgagaatttattggaagacataataaaaggggaataaacgactgtttagactaacacattccttatcgaaagcctctatgcaacaaaatacccctcaaaaagccgatgcttcatgaggggtaaacggtggtaagtatatgattggtattacaaagtcattggtgctcaatggtggatacaaccaccacaatctataaatccaaattttctatatgcagcgtattggcggctttctctttttgttcgtttacgatatgcgtataaatctgcgtggttttgacgttagtatgtcccatcaaagacttgatggtgtatatgtcaactccattttccagcaacagcgaagcgtagctatggcggccacaatggaaggtgatatgcttcttgataccggaagcttctatccagactttcaacgggcgagaaatccaagaggcatcagtcaatccttcaaaaacaagtgcttcatcatcgtctggacgtatgccgcatagttgaagtgcttgttgaatgacaggcttgtaatcgggcctttttgtcttttgctgaattacgactgcctgccatgtgcccttgcttgtttgctgaatttgtttccatttcaaagtttgaatatcactatgccgcaatccagtgagaatagagaacaagaacgcacgtttcaaaacatcatccttgcaaggagtatcaaccaacatctgcacttcattcatggtaagcgcaacacgaggtttctctatgtttgttattccctttactttcgcacttatatcaacggtcagatattcatcaatgaatgcctgttttaatccggctttgagtatagagaaataagtcgatgccgtgttttgtgagatagtacctttcttattccctcccattggggcacggagaaggaacatctttatatcttcaagcagtttaacggaaatcgccttgaatggaattggctccccttgtgaatacattttcaataattcgcctacacgcctccagttgactataatcgaatcggaactattgggatgacgtgtgcttataataccattgaaatacttgataaaatcctgttcgctccgctcattctgtgcagcgatttcgttttccttatcagtgtaaaggatggcactatcgtattcgtgttggcgtaacttacggacattgtcagcatagatacaagcctcttggtctatcgttgaacggcattggataatcccattcaaatcacgcttaggcttatagttgaatgttccatctggcaaaatacgtgcaatggacgatttgtcccaaacaggcgtggatatagtccggttaatagattccaccacacggcttgcccgtttagaacctcgcttataaactgggtatgattctataatcagataccactcttctttataattcgaccttctgagtttgacggtcactttggtatttggtaatgctttcttcattctacttctgacttatatagattatcaatttcttgcttgggtacatacacatagtttcctatttgtcttgagggaatagagtattttctaacatgtgcccatactgaactgtcattaatatggtacttctcacaaatctcagtaatggtatagcaatcctccggctctaagctgtatattttaggagcaggcttttctttctccgcaatactttccgatctgtttagaaaaagccgttccatttcagagcgtttgatacgtgtgagccttgtacccatattgatagttggaatacgtcccaatttaatcaggcgatacagagtgctacgttccaccccgaacatagcgacggcttcctttacagaaatgtactctctgatgtctgatacttgttgggcaatggcttctaacttcgcgtttctatcctttacatcctttttgcgtttccaagccactttaccacatttaggggaacaatagtgactgtcaagtgtttttgcgacaaacactttgccgcagaccttgcacttccgtttgatttcaaatccgattgttggcatgttatctacttttaagtatgtattagtatgtataagtgtgattaagtaccacattatctacttttttgtcttgtcgcaaacatgtcgcaaataagagataaaaaagcccatagaaaacacatagcaaccatgaaccccataaacgcaaaaagcgtgcaactcattgagctgcacgcttttgcttattgtttattatctgtatccttatcggaatcatttgacttcctcgaagtcagcatcctgaatatcttctttattattagaagaaccttgattagcctgttgtcctgcacctgcacccggaccggcctgagcgccaccttgtgcaccactctgagcatacatttcagcgctggcagcctggaatgctgtattcagttcagccatggcagtatcaatagcagacaaatcctgtgctttatgagcatctttcagtttctgaagagcagcttcaatcggagctttcttatcagccggcaacttgtcgcctaattccttcaactgattttcagtagagaaaatcatggagtcagcttgattcaatttgtcaatcttttcacgttccttcttgtctgcttctgcattagcttcagcttcggctttcatcttttcgatttcttccttactcaaaccagaggaggcttcgatacggatagcttgttccttgccggtagctttatccttggcagatactttcaagataccgttggcatcgatatcgaatgtcacctcaatctgaggaacaccacgacgagccggagcaataccagtcaaattgaactgaccgattgacttgttttgtgcagccatcggacgttcaccttgaagtacgtggatagtcacttcagtctggttatcggcagctgtagagaaggtctcactcttgcgggccgggatagtagtgtttgcatcaatcaacttagtcattacaccacccaatgtttcgatacccattgacaacggagtaacatccagcaataccacacctttgatttcatctgtcaaaacagcaccctgaacggcagcacctacagcaaccacttcgtcaggattaacacccttggaaggagtcttaccgaagaatttttctaccaattcctgaacagccggaatacgtgaagaaccaccaacaaggattacctcatcgatatcagagttgctcaagcctgcatcgctcatagccttcttgcaaggttcaagacaagcctgaatcaaattgtgagctaaagcttcaaatttagcacgtgtcaaagtcttaaccaagtgcttaggcataccatctacgggcatgatgtatggcagattgatttctgttgaagtagaagaagacaattcaatcttagctttttcagcagcttctttcagacgttgcatagccatcggatcttttgtcaaatcggcaccttcgtcattcttgaattcctgtaccaaccagtcaatgattacctggtcgaagtcatcaccgcccaagtgagtatcaccgttagtagaaagtacttcgaatacaccaccaccaaactcaaggatagagatatcgaatgtaccaccaccaaggtcgaatacagcaatcttcatatctttgtgagccttatcaagaccataagccaaagcagcagctgtcggttcgttcacaatacgtttcacttccagacctgcaatctgaccagcttctttagtagcctgacgttgtgagtccgagaagtatgccggaacggtgataacggcttctgtaacttcttgtcccagataatcctcagcagttttcttcatcttctgcagaatcatagctgaaatttcctgcggagtataaagacgtccgtcaatatctacacgcggagtattattgtcacctttcactactttataaggaacacgagcagtttccttctgtacctgatcccaagtttcacccatgaaacgcttgatagagaaaatagtacgttgcggattagtgattgcctgacgttttgcaggatcacctactttacgttcaccaccgtcaacaaatgcaacgatagacggagtggtacgtttaccttcgctgtttgcgattactaccggttcattaccttcaaatactgaaacacatgaatttgtggttcctaagtcaataccaataatctttcccataattatatatctttatttatttgttttcaattaaactgatttcttggcgaatggttcacgaaggacttcttttttctttggtgcaccaaccgcacgcccttcataaaacaaacggtatgccaaaaataagaatgtgacaaaggctgacaaaatgactgatttatttgctatatgatacttttaaatggattcatataaggcaagaatgtcagaactccaccaaatacaatacctgtcagcatcctagcataatgccataaatgcaatcggcctgttttctcgtttatgagaaaacaggccgacccatatcaattcgaatgtagatggattattgtttcttcaacaccaacaattcatttccattttcacctaacaaatatactttatcatctttcatgctgaaactttttgtttcattcaaagcattcagcacgatagtttcagtttccatatcaggacacatcatcatggtagtagcaacattgtcaaatctcaaagaattgggttttccatcttcctgcattaacgcaccatttatggtattacagcccacattaccgtaaatgcggctttcatccaaattaaaaccgataaaaggggtcacctcagccgtacctacaatcttctttccattcaccaattcaataacccattctcctgaaagatcagacagtgacacttccggagccgccttcttttccaaagtcatcaacggctgaccatcttgattacatagagttatcacgtcgggcttgtcagaaaccgtctggaaagaagtcactttatccaatgcacccaataccatctgctcagtcttcatatcagggcacatcatgcgggtacttcctatctgtccaaacttcaatgtacctggcttcagagagtcggcttcaaaacttcccatcatatggttacatccgctattgccataaatacgtttctgagctacatcaaaaccaatgaaaggcattctctctgtagatatcttctgtccatccacctctgtaatattccattccccatccagagaagaaacagacaacatattctttccactaccacaagatacaatcaatgctccggcacaaacagccatcattttcaatactagttttttcatattatttttttgttaaatctgttagtttagtgtgcaaaactaaccattttatttttcactatagcaattatacacaaaaattttatacctttgtatcaatttatatatactaacacttaaagcaatgaaaaggtttttagccattttaattggggcaacaagctgtagcctatgcacttatgcacaaaacggatatatagtcacgactacttcacaacaaacaagtatttccgtagaatctttggaaaaacagtttataaacgatcatttcaagtattacaacctgtgtgactggacaccaggcatgaaattcatggtgatgccggaacgtaaagacatcattattcctccttttaaatcggcggaaaccaacaaggaggtggatacaggagagttaaaacataagatttttgaatatctgggttcggaaattaccgaacggggctttgtacattttaactttgaatgtgaagggcaacaatattatcacgaacttaaaaacaccaccctggaacaatattgcctgaagcccaaagccggtattcctacccttgcctacctgggtgatgtggacatagccaaagaactgctggaaggacaaaccctatatatgcgtaccaataaagtacgtatagatgatcccaacagcatatcgggctataaagaggtcccgattggtataaatgaagaagtaacagtaacagctgtcggagtgggcagccgcgcataccctgtaaaaatcgtattccaagacaagaaaggaaacacctactatcagccagtagctatatcaaagactaattgtggcatggcagacagtgattttattatggaaaataaaaataaatattttccaaattcatttagcttcagtgatgcaaatacaaaaaaatcaaagaatctgatgagtaaatatggaaaaaaaactgtctatctgaaagcggaaacggaatgtctggatgaaacagacactccggtgagacttccccgatatacacaattcaccatcaaaaatataatctcacaaaacaactctccttacgtctttttagaattggaaaacatagatggaaagcattataagataaaagctgcattcacccatacgagtgtagttgatgtgattttacaatcagacaattattttacggatctattcggcataggcaacttacgaaccaagtatccgaatatcacagaagaagtttggaacatgataagccgcggtaaggtacgaaaaggaatgacaaccgacgaatgtcgtctggcattgggtaatcccatgcgcatccatatagtcacgggtggctatgaaacatggtcctacgaaagaaaaaccttagatttcaccaataagaaactagaccgtatccactaatacccaaaatattttgttatctttgccctgtgaacggtaatgtctgccgggcattttattttaacaagaataaaaaacagcaaatgggtaaagtattaattatcggtgcaggcggtgtaggtactgtcgtagcacacaaagtggctcagaatccggatgtattcactgacatcatgatcgccagccgtacaaaatcaaaatgtgatgcaatcgtaaaagctatcggcaatccagctattaagactgcacaggtagatgcggacaatgtagacgaactggtagccctgtttaatagtttcaaacccgaaatcgtcatcaatgtagctctgccttatcaagatctgaccatcatggaagcttgtctgaaagccggggtgaattatctggatacagcaaactatgaaccaaaggatgaagctcatttcgaatacagctggcagtgggcttataaaaaacgttttgaagacgcaggactgacagcgatactgggttgtggattcgatccgggagtaagtggtatttatacagcctacgcagcaaaacatcattttgacgagatgcactacttggatattgtggactgtaatgccggcaaccatcacaaagcgttcgctaccaattttaatcctgaaatcaatatccgcgaaattactcagaacggacgttattatgaagaaggcaaatgggtgaccaccaagccattggaataccacaaggatctgacttatcccaatatcggtcctcgtgattcctacttgctgtatcatgaagagctggaatcattagttaagaatttcccgaccatcaaacgtgctcgcttttggatgactttcggtcaggaatacctgactcatctgcgtgtcatccagaatatcggtatggcccgcattgacgaaatagattataacggagtgaaaattgttccgttacaattcctaaaagccgtactccccaatccacaggatctaggagaaaattatgaaggcgaaacttctatcggatgccgcatccgaggcgtaaaggatggcaaagaacgtacttactatgtttacaacaactgtagccatcaagaagcttacaaagaaactggaatgcagggagtaagctatacaactggagttccagccatgattggagccatgatgttcctgcaaggattgtggaaacgtccgggagtatggaatgtagaagagtttgatcccgatccatttatggaacaactgaacaaacaaggtttgccttggcatgaagtattcgatggtgatctagaactttaaaatagtgattaatggcccataattcatacttgggccacactaaccattaatcattaaccactaaaaaatgaacataggagataaagccccggaaatattaggcttaaacgaaaaaggagaagaaattcgtttaagtaattacaaaggaaaaaagatagtactctatttttatcctaaggatatgacatctggttgtactgcccaggcatgtaatttgcgtgataactatgcggaactgcgcgcccatggttatgaaataatcggtgtcagtgtgaatgatgccaaatcgcatcagaaatttattgaaaagaacgagctaccctttactcttattgccgataccgacaagaagttggtagaacaattcggagtatggggagaaaaaagtatgtacggacgtaaatatatgggtacattccgtacaactttcatcattaacgaagaaggcgtgattgaacgtatcatctctcccaaagaggtgaaaacaaaagagcacgcacaacaaattttataaaccaacagatttatggcaaaaaaagataacgaagaaattccattctcagcaagtccgagtgccggaaatagtgaaaaactgaaagcgctgcaagctgcaatggataagatagagaaaacttttggtaaaggctctatcatgaaaatgggtgatgacaacgtacaggaagtggaagtgattcctaccgggtctatcgccttgaacgccgcattaggggtaggcggctatcccaaaggtagaatcatagaaatttatggtcccgaatcatccggtaagactacattggctatccatgccattgctgaagctcagaaggcaggcggcattgccgctttcattgatgccgagcatgctttcgatcgtttctatgcggccaaactgggagtggatgtagataacttatggatatcacaacccgataacggtgaacaggcacttgaaattgctgagcaattgatacgctcatccgccattgatatcattgttatcgactctgtcgcggcattgactccgaaagctgaaattgaaggagatatgggtgataacaaagtaggtttacaggcacgtttgatgtctcaggctttgcgcaagcttacgtcagccatcagcaagaccaatacaacttgtatttttatcaaccagttgcgtgaaaaaatcggtatcatgtttggtaaccctgaaacaactaccggtggtaatgctctgaaattctacgcttccgtacgtttggatatccgtcgctccactcaactgaaagatggtgaagaagtaatcggcaaccagactaaagtaaaagtggtgaaaaacaaagtggcacctcctttccgtaaagccgaattcgatatcatgtttggtgaagggatctcaagagctggtgaaatcattgatttaggtgctgatttaggcattatcaagaaaagcggttcatggtacagctacaacgaaaccaaactgggacaaggacgtgacgcctccaaacaagtgattcaggacaaccccgaactggcggaagaactggaaggtctgattttcgcagcactgaaagaacaagaatagggatattcagtaaatgtctctaaaaaataagatggcatatgaagatgatagggacggaaaaacggaaggcaaacttgcaaacttgcaaaacttgcagcatctccacacacactaaaaaacaaaactaccatttaagacaagaacgaaatcaaagacaataaataagtaaattctataattctctttatacaaaaagacagacctgttttattcctccatttacaaataaaaaactatccacctatcagatgatccattaaaaagacgtatctttgccattcattatttttaatgctaacatgaaatacggagtaacaaaaaatacattacttattacagcaggcatagtttggctcttagccggtatcaacatcttacgtattggaataagttgctggataaacgattctcattattggttcttcaaagtctgtgaagctaccatagtatttctgttattctttggtctgatatttcataaactttacaagaaacatactcatcgcatatctcaaaagaaagccaagaattgtccattctctttcttcgatgtaaaagggtggattgtcatggcattcatgattaccataggtattttaacacgcaccctgcatttactaccggaagcattcattgctgtattttatacaggattgtcagtagccctaattacaactggtacccgatttatatggtactggtggagaaacaggcatctactagtctgataagtcattcggtctacagggatttccacgacggatgctatttttccctcgcacgatggcagcgaaacctccccaaaagaaacgacagtatcaccaatcactctttcaaatcgcatgtttcaagaaatctacaggctaccctacaggttgatatcactatcagagtgaatcgaagaaaatcatatcatgctacgctaaggtttccgcatcgagcagattaatcatacctgattgcaaattgttataagctcccgaacagttgttgtcattgtatggattcctcaacatacagttcggcaacctcaatgcgacatacatctacaccggtaaactccacaatacactcgcccacaacctgcgttatccttgcgcgaagtaaaccacaagtatcttgccttttcagccggatagtcgaaatcaccccggttctctccacttcctagcttttcgggtattatcaactgttctgtttctagcgtagaaatatcattaagaaaacatactgccacgctgaacaacggaaagagcaatagttaaataataaataaccttttcatcttctatcatttttttattggttgttacattcttcatctgtcacaacatgggatggagataaaatagcactaccgtaacgacggttcaacagttctgattgtgtagaatcaacacaagacgatgagccaactggttaaatcaaaccaataaaaaacaatcgccgcagaaataaatgtataactccctgcggcaattgttttattgtaatatccaagtacatcgatctatcaattgttttttactatcattggcacgtacttctatttcattccttccttttctgagagggacatccttgaacaaacaaactttcaaactgtctggtttcatctttccacactgacagtcattcacgatcaatatcacttcttctacattcgaaaaaacctgtacatcaacgagtggcttcactcgattcacattacgacgccccgcgatataaatcataggttccggattccaattggcccgataaaaataataagcatcctttttaatcttgcgatcatgggttaccagccctttgtcattaatgcccggacgatcaccttccgtacgatgagccgcaccgaaatcaaacatattccacacaaaactagcccacacatacggacgttcgtttattattttccaattctgaatgtgatattctgtttgccaattctctggatgccaccaacttccgggaacagtttgtaccaatgaatcctgctgatgatagatactagcacccgcaccatattcgctgatggcaattttcatttcgggatggttcttatgagtagcatccaaccatgtggcaagcgtagccggcgtagccccataccatccgtcatagcgattccaagctatatgatcagtaatgaaattcaacgcaccctcctgattacttgcagaagtagtaggacgagtaggatcctcttgatgcgctatagcattcaactcctttatatactctacaggattgtctccctgctcttttaattcattgaacaacccccaaaaacagatactaggatgattgtaatgctggcgtatcatctctttcaactgctctttaccattttcacggaaagaaggctgatcaacaaaacctttatcagcgtatcctcccggccccacaaatggaatctcagcccaagtaacaataccatgtttatccattaaatcatacatataggtagcttgcggataatgtgccagacgaacagcattcacccccatatcaagcatgatacgagtatcttcctcgtgatgcaccggacaaagagcattacccacttccgccttctcctgatgacggcatacaccatgcagcggcaagtgttttccattcaagaaaaaacctttatcgggatccgtgacgtaataacgtaaccctaacggctgttccactttgtccaattcttttccgtctttaatcaaagtcaacaccgcctgatacatgaacggatcctgcataccgttccaaagacgcggattcttcagtatgaaccctatatcctctacctgtacatctgtatgaggaatcatacttacttccttctccgtttcatacacagtttttttcccgtcattaacctgcaaccggagcactactttccggagttctcccgttccattagaaagatttacgcgtgcacaaatagttgcctgtttatccgtaacctgttgctgtatgagataaaccccagacgatgcataatctaacggagaaatacacaggttatcagtcagcaacagatgtacatcccgataaatgccaccataaaaattaaaatcaccgaccaatggcattacatccaactgctcgccattattgacacgtaccagcaatgcattctcttttccatattccactttatcggttatctcgaagacaaaagctccatagcctccccgatgctcacctatatgtttaccatttacaaagacattgctcacgcaattcgctccctcgaaacgtaaaaaaagccgcttgccttgccactcgggacggatgaatatctttttagtataattacctattccccgcttgtaatcgtgcttaccactcaaggcatcctgcgcattccaagtatgaggcaagtctaccctacgtgcagcactagcatttacttgatgggaaaaacggaaactccaatcctgattgataagcttatcttctctttgtgccaacacctgcatgctgaaagctgcggcaaataatacggtgaaagttcttctgaggtttttcatatgtatttttattattatactttgatttatgttccaacagcaaaaatagacaaaaaacttgagagagcaactaaaaaaacagaagaatagttgaatacgaaaaaggtaaaagtcaaaaccgccgtgaataacttttcttctgatattcacagcggcatatattataagcaaaataataaatcaacacatatcctctcagagatttttccaagcatttcttaataatatttcgtatagaagcatgctaaaaaatacctatataattacaaatataaaatccaacgatatattatcttattattttacatttagcttataaccaatagagagggttaaactgttataatttacacctatattatcatttttagattctttcccaagtgacatttcatattgaagcttaaccgtccacctccgattttcaagacctacagcggatgccattccccagtcgaaatttctcgcatgctgatatagaaactggttgctaccaccctccgcactttctcccacaccaggatatccttcaatccaaccggaagaaggcatagttagataatatggattgctgtcaatatgatttttgatacaatatcctatatatggtcctatctcaaagaaaaatttagtggaattgttgctatggatagagaatttagctaaaataggaacttgtaaaaaatgccttgtctgagaaacattttctatccatgtagcatctccattactatatgttccgccattattcacagagtatcctctaaaagtataatataatcccgacttcatagagaacacattattaacattataatctgcagatattcctaaacgagtggatggacgccaacattctccatatccagttctttgtattgcagataaccctgcttcggttgcccatgtaacacgctgagcattagcccacatgctacaagaaaaaacaacagcaaataataatacttttttcattgaaaaataaattaaagttagtaattctatagtttatactatcgtgtcgctataatctttttcatcataataacttcattttttgacagaatgacaacaaagttccgttttacccccatccatgaaatcatttttatttcaaactaacattttaccaaaccaataaaattgaatgtaagtacgatatagcgatgactgatccgctaaaaaacaatacaatggaaacaagcaataagtattgtttcaggcttacaaaagaagaagccattttaaattaacacattgaatgcatgattttttatatatttccacatcaacaacaattcatcttggtacacaataaaaaaggagccacccaatgaactaaagccatcgacaaactaaggtcagaatatcctcttgacttattattgaagttgagaaagatgattctgtctgtattctattatcatctgaaatacctgaaacaaacaataaatatgccatgaagaaaaaacataaagcctatcgtcacataactgcggaaaatatatctatctccattttgcaaaatcatactattccaaaacattcatttgtggatcatccgctccaatccattagcaagcagtgcctgggaacaggcaatattccggtgaataaatctgagtcagtagatttttattgggagtaatttttaccctcatacagtattgcatgagaaaaaaaagttccggttatgctttgacagaatacctatacttgaatggttcaagatgaaattcaaagagtacaaaaagaggaaaaacagaccgaaaagaggattaagaacataatattcaataacaaaaaaaaataaaaatgcaattttgacagtcaataaattgcatttttatttctatttttgtggttatctgcgaggctgaataataatataaatttaacaagatgtcatgaaaaagaaaatgattattatatttttaagtacaagcatatcgctactattttcttcatgttcaactatactagaaattataacaggagatagacagtgtatatatcctaattgcacagaacgggctaccagcaactcagcttattgctcatatcacaaaccgtactacttaaaataaacatttatctacgtaattaacacgttgaaaaagatttaaaatgccttatttcaaaatattttcaggtatttgagggaatagagttacatctccattcactacgtattccgtaccctcttcttgcatttgcatcgtaggagcaagtgcaatatctgaacgtatgtttacaaactttgatagttggtcccaatccacacctaaatacttatttagaatactatatattgcagaagaaggacctatcaaattaaatttatgacttgatgcagaaatattttcattagttagtttgccatcttcgtctgttttataggttaatgtcagaaatggcattgtttcatatgagaggttgggattattatttttctcgacagagaatttataacaccccttacttataaaattctcatctactttatgctctaaataattaatacccaatcttacatataataaaatgtaaaattgagtatctattatgtaatctactgataatcagtattttcgcggtgcgtacgggactcgaacccgtgaccccatgcgtgacaggcatgtattctaaccaactgaactaacgcaccaataattttaataaatcaaaaaagacttgcggtgcgtacgggactcgaacccgtgaccccatgcgtgacaggcatgtattctaaccaactgaactaacgcaccagtaattttgataaatcggaaaaagacttgcggtgcgtacgggactcgaacccgtgaccccatgcgtgacaggcatgtattctaaccaactgaactaacgcaccaataattttgatagtctctcttccgacgctttctctctcgattgcgggtgcaaaggtacgcattatttttaaatctgcaagcgttttggcaaaaaccataaaaaaaatattttccaactcccttcacctccccaccctaaaaattacgatattgttattattttaatcttttcaacaaacttcttgttataaaatttagcttattggcaataattcgctatttttgtgcactcaatagattaaaatcgaaaattagggaaaaagatgaatacaactgcaaaattattgttgcactgcccagaccaaccaggcattttggcagaagtcacaaactttattacaattaacaaaggtaatattgtctacttagaccaatatgtggaccatgtagaaaatatatttttcatgcgtatagaatgggaaataaaggatttctttattcctaaaaataaaatagaagattattttgaaaccttgtatgcccaaaaatatgaaatgaaattccgtctttatttctcggatgtaaaacccaaaatggccatatttgtttccaaactgtcccattgcctgttcgatatgctggcacgctacacggccggagaatggaatgtggaaattccgctgattataagtaaccatcccgaccttcagcatgtggcagaacgtttcggtataccgttctatctcttccctattactaaagagaacaaaaaggaacaggaaaaagcagaaatggagctgttggaaaaacataacatcaatttcattgtactggcacgctatatgcaagtgatttccgaacaaatgattgaagcatatcccaaccgcatcatcaacatacaccactctttcctccctgcgttcgttggtgcaaaaccttatcatgcagcgtttgaacgaggagtaaaaatcattggtgcgaccagccattatgttacctccgaactggatgccggtcctatcattgagcaagatgtagtacgcatcacacacaaggacactgtgcaggatttagtaagtaaaggtaaagatttggaaaaaatagtcctttctcgtgctgttcagaaacatattgaacgaaaagtattggcttataaaaataaaacagttatctttagctgatgaaaattgctgtcgtaaaatataatgcaggaaacatctactccgtagactatgcactgaagcgccttggagtagaagcaaccatcacttccgataaggaagtattgatgagtgccgacaaagttatcttccccggtgtgggcgaagccgaaacaaccatgagccatctccggaaaaaccggttggatgaagttattaaaaacttaaaacaacctgtactaggtatctgcctgggaatgcagctgatgtgccggcactccgaagaaggaaatgccgactgcttgggcatctttgatactgatgtaaagttgttcagccccacccggcatgaagacaaagtaccccatatgggatggaacaccctgactcatgtacgcagcgacctgttcaaaggattcaccaaagaagaatttgtatacttcgtacatagcttctatgtgcctctgaacgagtttacggcagcacaaacagattatatcctcccctacagttcggccttgcacaaagataatttctatgcgacacagttccatccggaaaagagcggagccgtgggcgaacgaatcctgaggaactttttagaattgtgaaccattacattatatataacaatgcataagaagaaatagatatgatagagttaattcctgccatcgacattattgatggcaaatgcgtccgtctttctcaaggagattataacacacagaaagtatataacgaaaacccggttgaggttgccaaagaatttgaagcccatgggattcatcgtctgcacattgtcgatctggatggagcagtttcacgccatgttgtgaattaccgtgtactggaccaaatcgccagccgcacttctctggtcattgattttggaggagggataaaaacagacgaggatctagtcatcgctttcgacaatggcgcacaaatggtaaccctgggcagcgtagccgtgaaaaatcccgggcttttcaaaaaatggctggaacaatacggaaacgagaaaatcattctgggagctgatgtaaaggagaataaaatttctgtcaatggctggaaagaagaaagtcagcagcagttgatcccttttttgaaagattatactaaagaaggggttttcaaggtgttatgtaccgacatcagccgtgacggaatgttgcaagggccttccgtggaactataccagcaaatcctgaaggagttcccgaatatgcatctgatagccagcggaggagtaagctgtatacaggacattatcgacctggaaatagccaaagttccggctgttgttttcggcaaggcattatacgagggaaaaattacattgaaagacttaaaccgtttcatgtaagagcaaatcatgttagcaaaaagaatcataccttgcctggacatcaaagacgggcagaccgtaaaaggaaccaatttcgtaaacttacgtcaagcaggtgatccggtagaactggggcgtacctacagtgaacagggagctgacgaactggtctttctcgatatcactgccagccatgaagggcgcaaaacctttaccgatttggtaaaacgggtagcggccaatatcaatatcccctttactgtaggaggaggtataaacgaactgagcgacgtagaccggctattgaatgcaggagctgacaaagtttctatcaattcatcagccatccgcaatccggatttggtagacaagattgccaaacatttcggttcacaggtctgtgtggtagccattgacgccaagcagactgaaaccgggtggaaatgctatctgaacggcggccggattgaaaccgacaagtacctgtttgactgggctaaagaggtgaacaaccgcggggcaggagaaattcttttcacgagcatgaaccatgacggagtgaaaaacggatatgccaacgaagccctctccaccctggcggatttactgacaattcccgtcatcgcatctggaggcgccggatgcatggaacatttccgcgatacatttgcaaaagggaaagcagatgctgcattagcagccagcgtttttcatttcggagaaattaaaattcccgaattaaaacagtatctttgcgagcaaggaattaatgtgaggttataactctgtttttaattgcatctaaatctgtttccactaccatcccaaacaggatgaaagactggcaaacgaccttcagatcctcattccactctgaatgacgatgctgatgaaattttaaacaagttctatacaacaccgataatataacaataaaatatagaaaaatggatttgaatttcgaaaaaatgaacgggttgatccccgccatcatacaagacaacagcaccagcaaagtactgatgttagggtttatgaatgaagaagcataccgaaagacagtggaaaccggtaaagtaaccttcttcagccgtaccaagaaccgtctgtggacaaaaggtgaagaaagcgggaatttcctgaatgttgtttctataaaagaagactgtgacaaggataccctgctgatcaaagtaaatccggcaggtcctgtatgtcacaccggaacagatacttgctggggagaagaaaacaaagaagacatcatgttcctgaaggaattacaagatttcattgacaaacgtcacgaggaaatgcctgcaggctcttacaccaccagcctgttcgaatccggtatcaacaaaatggcacagaaagtaggcgaggaagccgtggaaacggttatcgaagcttgtaacggaaccgacgaacgcctcatctacgaaggagccgatctgatataccacatgattgtactgctcacctcaaaaggctatcgcatcgaagaccttgcccgtgaattgaaagaacgtcatagcgctacgtggaaaaaacattaaaatgatggacgaagctctcattcgatataaaaacgtatatatcaaccaacaagagttaggcgtattggaagatgtaaacctggaactgaacaagggtgaatttgtttacctcattggaaaagtcggttccggaaaaacctcattactgaaaacaatttacggtgagctggatatacagtcaggagaagctgaggtgttaggctacaacatgactaacatcaagcggaagcatattcccgaactgcgtcgccgtttaggcattgtctttcaagattttcagttactgacagaccgcaccgtacacgcaaacctcagttttgtattgcgcgccaccggatggacaaacaaagcaaccatcaaagcacgcattgaagaagtactggaccaagtgggaatgaccggcaaaggatacaaaatgcccaacgagctatcgggtggcgagcaacaacgcattgttatcgcccgtgccatcctgaaccggccggacattattctggccgacgagccgacgggtaacctggacaccgaaacagggcgcaaaattgtagaacttctgaaatccatttgtgctacaggctccgccatcatgatgaccacccataatctgcatctcctgtcggaatatccgggagttgtctaccgctttgagaatcatcatatcaaagaagtaactcacgaatacagccggatggaaagaagtcaaaatgagaccgaaaaaggagaaaaaacgacagttacaccccaagaaacggcagaataagtagatgaatgataaatatcatcgctaaaatgctgatttttgcagtcttatttgtatatttgcacgctaattatcaatataggaacaattaaaatacgaaacgaaaaatgaaagttttaaagtttggaggtacttcggtaggttctgcacaaagaatgaaagaagtagccaaattaattaccgacggtgaacagaagattgttgtactttcagccatgtctggaacaacaaacacgttggttgaaatttcggattatctgtataagaaaaatcccgaaggtgcgaatgaaatcattaacagactggaggctaaatataaacagcatgttaatgaactttattctactgacgagtataagcagaaaacacaggaatttataaaagcacagttcgattatattcgttcgtatacaaaagatattttcacactgttcgaagaaaaagtaatcctggcacaaggcgaattgatctccaccaacatggttaccaactatttgcaggaacaaggggtcaacgccatcttacttccggcattggaattcatgcgcacggacaagaactcggagcccgatcctgtatatatcaaagaaaaactggccgcacagctggaaatacatccggatgctgaaatttatatcacacaaggttttatctgccgtaacgcctatggcgagatagataatctgcaacgtggcggaagcgactataccgcatcactgatcggtgccgctgtaaacgcctccgaaatccagatatggacagatattgacggtatgcacgataatgacccgcgcatcgtagacaagacttctcctgtacgtcacctgcacttcgaagaagctgccgagttggcctactttggtgcgaagattctgcaccctacttgcgtacagcctgccaaatatgccaatattcccgtccgtctgcttaatacaatggaacctacagccccggggactttgatttccaatgatacggaaaaaggcaaaatcaaggcagttgcagccaaagacaacatcactgccatcaagatcaaatcaagccgtatgttactggcccacggcttcttgcgcaaagtattcgaaatcttcgaaagctatcagacctctatcgacatgatctgtacttcagaggtcggtgtttccgtatccattgataacaccaaacatctgaatgaaattctggacgacttgaagaaatatggtacagtaaccgtagatcaggatatgtgtatcatctgtgtagtcggtgacctggaatgggaaaacgtaggctttgaagccaaagcgttggacgccatgcgcgacataccggtacgtatgatttcattcggcggtagcaactacaatatttctttcctgattcgtgaagaagacaagaagaaagcattgcagtcattaagcgatcatttattcaacaataaataatttctactgtaggggcggattgaatccgcccgaatacatcccactctacaaagttggtgttttcgggcgaatttaattcgcccttgctcataaaaacaaaatacaatatgaaaggaacattccccgtaaacaagttcagagagttggaaactcccttctactattacgatgtcaatgtgctgcgagaaaccttgtcatgcatcaacaaagaagcaggcaaatacaataatttctgcgtgcattacgccgtgaaggccaatgctaaccacaaagtcctgacaattatccgcgaaagcggtctgggagccgactgtgtaagtggcggagaaatccgcgcagccattaaggccggattcccgacaaacaaaatagtctatgctggtgtaggcaagacagactgggaaattaatctgggtctggattatgatattttctgcttcaacgtagagtccgtacccgaactggaaatcattaacgaactggctgccgccaaaggcaaaacagcccgtgtagctttccgtatcaatccgaatgtaggtgcgcatacccatgcaaatatcaccaccggactagcagagaacaaattcgggatcagcatggaagatatggacaaagtgattgatatggccggaacattgcctcatgtaaaatttgtaggcttacatttccacatcggttctcagattctggatatgggtgattttgtagccttgtgcaaccgtgtaaacgaactacaggaaaaactctatgcccgccaaatcatagtagaacatatcaatgtaggcggcgggttaggaattgattatgcacaccccaaccgtcaagccatccccaacttcacggaatactttgccacttatcacaagcatctgaaactgcgcccccagcagactttacatttcgaactgggacgtgccgtagtaggacagtgcggcagccttatcagcaaagtgatttatgtaaagcaaggaaccaacaaactgtttgccatattagatgccggcatgaccgacttgattcgtcctgccctctatcaggcataccacaaaatagaaaatatcacttcggaagaacctatggaaacttacgatgtggtaggccccatctgcgaatcatccgatgtattcggcaaggctattgatttgaacaaagcacaccgtggcgaccttttcgctctccgttcagcaggagcatatggtgaaattatggcatcggcttacaattgtcgtgcattgcccaaaggatatacctcagaagagttagtataaaccaactccaactgcctgaataaataagaaacagcgccgctttgatgcaaagcggcgctgtttcttatttatcttccggaatgaaatcttcttttataaattcatcatacacacgccgtggatgatccgcttttgaaaatccattattaccaaaattctgttcacggaacttctttagctttaaattatcttccgcatactcacgcaaagttttctgtttgcctcctaatatggaactatccagcacctcacattccaacagattttccttcggagtaattattggaaggagcttctgttccaaaaaaccgcgataggcccccacatactcgcaccagcactcccccttcacctcataaatacgatacgtgtacttagacaaagcagttctaataaaaatttcattccccatcacctcggccacggcttctaagttataagccaagtctttaatcttgataatcttctttcctgactcatcttccttgatttccgtagcccaaaagtcggaatgcataagctgatcaagtatattgatcaaactttctttaatctcaaattgtattctcataataattgcccgttggtcaggacttgttacaggtttcagttaacttctttaaatatagcaattatacttgaaaaatattcacgaaaacacacttttaacattaaattataattaaatctgaacttttgaataaataaagaatattcatcctgctacaattcaattatttgctgtatttttgcacgtttttaaaacagatcacacatggaaccattcaccatagatataatcttaccaatagcttcgggagccttattcaccacgcaggccgtttactatctggggctatataacaaactatacactcacagcagagaaacagcatatgccactgatataaatacccaaaatcctccactgtctgtcatcattgtggcaaaagacgcagcccacgaattacaagaaaacctcccatttattttagagcaggactatccggaattcgaagtgattgtgatttacgaccgcccggcggatgattgtgacaatacgttgaaattactggaagacaaatatcccaatctctatcatacctttatccccgacagtgcacgctacatcagccacaagaaactgggaataacaatgggaattaaagccagccgccatgaatggctggtatttaccgaacccgattgccgtccgcaaagcaatcaatggctgaaacagatggcacgtaatttcacacctgccaccgaaatcgttttaggctacagcaactacgaaaaagtaccgggatggtttaataagaaaatcactttcgacacgttgctgaattctatgcgttatctgggtatggctgtttccggacatccctacatgggcacaggacggaatatggcttatcggaaaacactgtactacaagcagaagggatttgcctcccacctgaatctgcaacgtggagaagatgatttgttcatcaatgaaacagcccgtgcacacaatacacgagttgaagccagccctgaaagtctgatgcgaatcgccatgcctaaatataaaagaatatggtgtgaagagaaaataagctatgcggctaccagccggttatttcatggaaccgcccgttatctcatgggatttgagacttgcagcagattcttgttctatacagccatcatcgccactataaccatcagtattcttctccaccaatggactattgcaggcattgccgttttgctatggtcagcacgcttcacgatgcaactgattgttttcagaaaaaccgccaaagtttttggcgaacggaagttctgtgcactactccccttattcgattttctgcaacctgcatggaatggggtattcaaattacaacgtaaattcagacggaaaaatgagtttatgagaaaataaaaagagaatgaaaccaactatacatttcttaatttaataatacgaattatgatcagattaaatgtttttatccaagtaaacgagagtaaccgcaatgctgtcttagaaacagcaaaggaattggtagcgcaatctttaaacgacaagggttgcatcgcttatgatatctttgagagcgcgacacggaaagatgtccttatgatttgcgaaacatggaaagatgctgagtcactggatgcacacgaaaaagctgcacattttataaccttggttcctaaattgcaagaattgggcaagatgaaattagaaaaatttgaattctaaatccggttatccatcttgatccgacaaaaacaaatcagggcttgtttatacaaaccctgatttgtttttatccgccaagaaaggttatgcaagaaacacttttccaccaatgtaatcactgcctgaaaaaacagaagagtatcacattatccagcataacaaattgaaaccttttatcgctttatattctctaacacaccccaaacagcccctttttcattgttttcacccacccatgcacatgcaatattattcggtaaaactataaatgtaacaatttaaaaccttcgttttacaacgaaatatcacaaatattgtttgttttatatcatatttcgcttcaataagatttaatatgtatattatttgcatattaaagacaattattctacttttgcacccgttttaaaaacaacaaaaagtttcaaattgaaagcataagtatgaaaataatctggtccatccgttctttcaactttaccaacataccgtaaatgcgtttgtccaaaagcgtgttataagtaatattgtaaaatcagaaaaacagttgaatctcatgtttactttcatttctataatggctgtcggagtccttataggctatcccttacgccacaaatcccaagtacgcaagatcactcctctcatccatatcgtggtctgtctgctacttttcttactcggtctctctattggtcttaacagactgattattgacaatcttggttacttctgcggccaggcagccgtcatctcctcattaagcatattgggcagcatgatggcctcccttgcagtataccacatctttttcaaaggaaagggggcaagcggtgaaaagtagtcttgtaactctagcctttttcttgtttggctgcgtagccggagtcagctatgcggtggacttcgacgtacaccaaacctctgtatatgtactatatgtactgatgctgttactcggcattaatcttggaagcaaccgcaacctcaggcagtttgtcttatccctcaatttcagaacactgcttgtaccccttgccaccgtaagcggcactctgctgttttccgccatcggaggctttctcttgagccgctggagtattttcgactgcatggctgtcggaagcggattctcctattattccgtttcctccatccttatcacgcagatcaaatccccctccatcggtgtgcagcttgctaccgaattggggaccatcgcactactatccaatattttccgggaaatgaccgccttgataggagctccccttttccgcaaatatttcggttatctggcgcctatctcggcggcgggcatcggttcttccgacatttccctggcagccatcgcacgctgctccggaccggaagccgtacccgtggccatcgtccacggcatactgataaacataagcatgcctttcttcgtttctttcttctgcaaactgtgaactgaaggaagtgacatactatacgtaactttacattctctctataaagaaccggccctgtcacgaattcgcagcagggttggttctaacacatccgcccgactaaagcatttcttcctaacaattaggtcttttctttctatcaactactacagactttcacaacagactgtacagtccattacatcagaccgtacagtccactataatggactatacgattcactgtaggagactgtagtacattaccgcataaaaagacttaatcataagggaaaaagaccttagcattataggaaaaaaggattaataccggatatacggaaaacgcagaaagagaatcttctcattcaaaccgaatagattttgccggatgaatacgcgtcaccagaaatgacggcccgacaagcatcagcaccgacaccagcaaagtacagacattcagcaacaaataaatccaaatgttgaattcaacaggaacacgatctacataataagtggcagggtccagtttgaaaagatgaaattgagattgaataaagcataatgccaccccgatgatatttccccatagcatccccctgcctatcaagaatacagaaaaactgaggaatatcttacggatagcaaaattatcagctcccaatgctttcagcaccccgatcatattggtacgctccagaatgataatcagcaaaccggatatcatggtgaatccggccacccccgtcatgagaaacaagataacccacacattcatatccagcaaatccagccatgcaaatatctgaggattgacttcctccaccgtctgagtatagtaagtacctccgtatgcatccacctgcgtatccacccgtgcacggatttcctccttcaccggctccaaccggctatactcattcacttccagttccataccactcacctgccctttctgccagccattcaaacggttcaccgtatataagtcggttatcagaaacaaatcatcgtatgcggaaaaattggtctgatagatgccggcgacagtaagacggcgggcgcgcacattatcctctatataataggtatagattttatcacccagtttcagatgaagcttgtcggcaatagtgcgggacaccaataccttattggtagaggcagtatccgagaaaacaggaatttccccttcctgcaaatgattctttaaaaacctccagtcgtattcatgagaaacacctttcagtaccattccctgaaagctgtcgtctgtcataatcattcccggcttggtggaatagcgctgcacgtgcttcactccttccagtgttttcaacagatggagcaaactgtcgttggcaacgatgggaaccgtctgataagattgctgggagtcgaagttcgttattacgatatcggaccccaagcctaccaccttgtcgcgtacctcatgtttgaaaccgatcaccaccgctaccgacacaatcatgacggccagcccgattgctatgcccagcatagcaatgcggacggcaggcttggacacctcttttccaccctcattgctgcgatagatgcgtctggcaataaagagcttccagtccatatcagtcttctacccttccgggatatgcttccaatgccttacgcagtacgaacaacgcacggaccagatcctctttcttcaacacgtaggcaatacgcacctcattacggcctgcaccgggagtggtatagaatccggcagccggagccatcatgaccgtctcgccttcatagttgaattccgacagacaccatgcacagaacttctcgctgtcgtccaccggcaatttggcaaccgtatagaatgcacccatcggtatgggcgaataaacgcccggaatacggttcagcccgtcaatcaggcacttacggcgctccacgtattcgtcatacgtctcgcgtgtgtactcttcgggggcatccaatgaagcctcggcagcaatctgaccgatcaaaggaggactcagacgcgcctggcagaacttcatgacggcatttctcacttccttattcttggtaatcaacgcaccgatacggataccgcattcggaataacgcttggacaccgagtctatcagtaccacattttcttcaatgccttccaagtgacaggcagagatataaggagaaccggtatagataaactcgcggtacacttcatccgagaacaggtaaagatcatacttcttcaccatgtcacgaatctggttcatctcgcggcgggtatacaaatagccggtcggattattcgggttacagatcagaatagcttttgtgcgttcgtttatcaactcctcgaacttctccactttcggcagggagaacccttcctcgatggtagtcgtcaccgtgcggatcacggctccggccgaaatggcaaacgccatatagttggcataggcaggttccggcacaatgatctcatctcccggattcaagcaactcagaaaagcaaacagcaccgcttccgaacctccggtagtgatgatgatatcatcggcagacaagttgatgtcatatttcttataataacccaccagtttctcgcgatagctgcggtatccctggctgggactatattccaaaacggtacggtcaatattacgaatcgcatcaagggccgctcgcggagtaggcaggtcgggctgaccgatattcaggtgatacacatgaattcctctctgttttgcagcatcggccagcggtgccaatttgcgaattggcgatgcgggcatctcgtttcctctgatggatattattggcataatgttataaaaattatttaatcgaagtgcaaagatagactttcgcaaccaaccgagcaaacaattaattaagaatttaaatctttgttatcttaatgcgcattttttagggttattaaaaaaaaacatgtaagtttgttccagtaaaacaaagcaaaatatcaaatgaatctatacctgataaccttccagtcctccttgaacagaattgaatctgtatatgattgccataaagatttatttgtggaaatcgagaagtttttcacgcttcatctggtaccttatacagaggctgcaagtattccggcagatgcctaccggatggctttcatcgcttcgggcggggtagaaaaaatggtcacccaacacttcgaactacttccctatcctatccatctgctgaccgacggacaacagaactcactggctgcttccctggaaatagctacatggatacgaagcaaaggaatgaaagtacatattattcatggcactatccccaatatggtgaaacaactgatagatcatcacaaggctttcgccgcccagcgcgaggtaagaggaaaacgaatcggagttgtgggatattcttctccgtggctggtggccagcaatgtagattacctgcttgccaaacgccgctggggaatagagttcattgatatccccatggaggaagtgtattgtctgttttatcagataaaggatgatgatataggatatgaggcgtccgtatttgccaaccgtgccattgcctgccgggaagggactccggaagatttgctgaaagccatgcgtctttatcaggccgtgaaaataatctgcgaaaagaaaaagctggatgcggtaaccctctcctgcttctcgttgattgagaaattaggaactaccggatgtctggcacttgccctgctgaatgatgaaggcatcccggccggatgtgaaggagacttgcaatccatctttactctgctcatcgccaagacactgaccggccaggcaggattcatggcgaatccggcattcatcaacgatgacctgaacgaaatagtgatggctcactgtacgattgccaccaaaatggtggatcagtttatcatccggaatcattttgaaacggagaccgggatagccatacagggtattctgcatccgggaggcatcacgatgataaaatgcgcgggagagtgtctggacgagtatttcgtttccacaggccaactgatagaaaataccaactacatcaatgcctgccgcacccaggcaagaatcaaactggacaaatccgtagactattttatgcgtaatcctttgggtaaccatcacatcatattaatgggcgatcatgaaaaagtgattcacgaattcatgcaattgaacagctgcaaactagtggaataaggaaagcatgaagaaattaagtaaaatgggagacgaagattaaataaattgtatctttgtatccaatttaatattcaataaaacaataaacttttatgatgcatacttggtttgaatgtaagatacgttacgaaaaagtcatggaaaacggcatgaacaagaaagtaacggaaccctatttggttgacgcgctgagctttactgaagcagaagcccgtattattgaagaaatcactccgtatatcagcggtgagttcactgtttcggacatcaaacgcgccaactacagcgaactgttcccctctgaagaagatgcagccgaccgctggtttaagtgcaagctgttcttcattacgctggacgaaaaaagcggagcagagaaaaagacctccactaccgtactggtacaagcttccgaccttcgcgacgctgtaaagaaactggacgaaggaatgaaaggtacaatggcagactacgtgattgcgtccgtagccgaaaccgccatcatggatgtttacccatacgaagccgaaccggatgtgaaacctgaatttccggatgccggaaaaaccgaataaagcctgataaaaaaatagaaagtataacagataatgagcattcaagcaaatttaaaagaagttctttccgaactgcctgcgggtgtccgcctggtagccgtatccaaattccatcccaacgaggcgttggaagaagcgtatgctgccggccagcgtattttcggtgagagccacgtgcaggaaatgactcagaaatatgaaaccctgcccaaagacattgaatggcatttcatcggccacctgcaaacaaacaaagtcaaatacatggccccttatgtagctatgatacatgccatagactcgtataaattgttggttgaagtcaataaacaagcttccaaagtccatcgcgtcatcccttgtttattgcagatacatatcgcccaagaggaaacgaagttcggtttctcttttgacgaatgcagggaaatgctggatacaggcggatggaaggatttgaaaaatgtccgcttatcaggagtgatgggtatggcgaccaatgtggatgacgacgaacaaatcaaaagagaattttgttccttaaatacattcttcaaagaaataaagcagaactatttttctgattcagaatactttaaagaaatttccatgggtatgtcacacgattatccgctggcagtggaagccgaaagtacactagtcagggtaggaagcaaaatctttggagaacgaaactattaaaactactatttatatgactcaattaaaaaccacttttgccgggttgtcactgcgcaatcctataatcatcagcagttccagccttacaaacagcgctgaaaagaacaagaaactggagctggcaggcgccggagccattgttttgaaatcagttttcgaagagcagatcatgatggaagcacatcacatggctacttatggctctcccgaaggagatgactacttgagcacatatgtacgctctcatgcattgaacgaatatatttcattgattgaacagactaaaaagctttgcaccattcctgtcattgccagcatcaactgcttcagcaactcagaatggacagactttgcccgtaccgtggaagcagcaggagccgacgcactggaaatcaacatcctttccttgcagaccgaaaaagaatatcaatacggttctttcgaacagcgtcatatcgatatcgtaagcagtatcaagaaacagatttccatccccgtcattgtgaaactgggcagcaatctgaccaaccccatcgcactgatcaaccaactttatgccaacggagccaatgctgtggtattgttcaaccgattctaccagccggatatcaatatcgacaccatgacatattctgcaggcgatgtattcagtactcctgccgacttgtccaacggactgcgctggactgctatcgcttcggcacaagttcctcagacagattatgccatttcgggcggtgtgcacgatggaaaagcgatagtcaaagcaattctggcaggcgcttccgctgtagaactgtgcagtgtcatctaccaaagaggcaatcaggtcattgcagatatgacaaatgaaatgacccaatggatgaaccggcaaggctacaaggacatcagcgaattcaagagttcgatgaacgcactgtctaccggagccagcaatccgtttgaacgtacacagttcatgaagtatttcagcagcaaagaataaaaatcagtggttagtgattagtggttcatatccatgcgacatcacagcgcagctcattaaccactaaccactaatcactatttttccttctgtttaatttgtatgctccaaagaaagtcttatatttgcacatttgattaaagtttgtgcaaaatataaacaaaagagtatatacaatggagcagagttttattgccttcctggaagacagtataaagaaaaactgggacttggatgcccttacagattataaaggtgccacattacaatataaagatgtagcccgcaaaatagaaaagctacacatcatcttcgaattaagcggcatcaagcaaggagacaagatagctgtctgtggccgcaacagttctcattggggagttactttcctggctgccgttacatacggggcagtgattgttcccattcttcacgaattcaaatcggacaacattcataatatagtcaatcactcggaagcacgcctgctgatggtgggcgatatggtatgggaaaatctgaatgaaaatgccatgccgttgttagaaggggttatcttgatgaatgactataccctgctagtttcccgcagttccaaattggactatgcacgcgatcatctgaacgaactgttcggaaagaaatatccgcgcaatttccgccgggaacatgtcagctaccgccgggatacaccggaagaactggctgtgatcaactatacttccggcacgaccagttattccaaaggagtgatgattccttaccgcgcattgtggtcgaatacccagttcgcttttgatgtcttgaaaatgaatccgggtgacaagctggtttccatgctccctatggcacacatgtacggactggctttcgagttcctttatgaattctgtgtgggatgccatatttatttcctgacccgtacccccagtccgaaaatcatcttccaagccttttccgaagtgaaacccaatctggtagtagccgttccattgattatcgaaaaaatcatcaagaagaatgtactgcccaaactggaaaccccggctatgaagattttactgaaagttcctatcatcaatgataaaatcaaagccacagtccgcgaacagatgataaatgccttcggaggtaatttctatgaaattattgtaggaggtgccgccttcaatcaagaaatagagcagttcctgaaaagtatagatttcccctataccgtgggatatggcatgactgagtgtgctccgattatctgttatgaagattggaaatatttcaagccgggttcctgcggaaaggcggctccccgtatggaagtcaaaatattgagccccgaccctgagaatatagtaggtgagatagtatgcaaaggacctaatgtaatgttaggctattacaagaatcccgaagctaccgccgaggtaatagacaaggacggctggttgcataccggcgacctgggtgttatggatgcggaaggcaacgttaccatcaagggacgcagcaaaaacatgctgttgggtccatcgggacagaatatttatccggaagagattgaagataaattgaataacatgccgttcgtttcagaaagcattatcatacagcaggcagacagcaaactggcggctttggtttatcccgatttcgacgatgcctttgctcatgggctggataatgacgcgatagcacaggctatggaagagaaccgtatcaacttgaatacagaacttcctgcatattcacaaatagcccgtgtaaaaatctatccggaagaattcgagaaaactcctaaaaagagtatcaaacgtttcttatatcaggaagtaaaataacacctgacagaaaaagaacctgcctgcaacatatataatgtataagtctgaagattatagatgttgcaggctatacattatagatgttacaggttatacatccgcatatatggacacctggatcatgatacgtgaaaggagacaaaacaaaacataattttactcttgcaccccgatcaattctccccataattcccccttatatctacatttttattacatttgcacccaagaaactaaaaatgtatgaaaatgaatatgcgtatagcagcaatactccttttaggatattgtgcaggtatgtcaactcctgcttttgcccagaaaaaggacaagcttaaaaaaggccccaacatctccttgaacatttccgcgaagaaagacagtgtcaaaaccacttatctgaatatcggtctgcttacaaatatctatcaactgaaaggaatcggtatcaacgctgtatccagtgttgtacaaaacgatatgacgggtttccaaatctccggccttgccagcattaccggacgccacgcctccggtttccaactgggaggtattgccaatgtagccggaggcaatgccaatggcatcatgctcagcggactgatgaatgttgccggagggaaagccaacggtatccaaatttccggattaggcaacattgccggaaacatatcaagaggagttaccatcggcggtctgatgaatctggccggcaacaaagcccaaggagttcagatagccggcttggccaacattgccggaaaatcacaaaatggcatcgctatcggcggactgatgaacgtatctgccgagaaactgaacggagcacaagtttccaccctgctcaatatcagtggcggaaaagccaaaggcgctcaagtctcagccattggtaatgtaggtgtaaacgtgaatggtatgcaattctccgccatcagcaatatcgctgccggagaaatcagaggcttgcagctttgcggtgcggtaaatatcgccgtcaagacggaaaatgccctgcaattctcaggactgaccaatgtttgccaaggcaagttacgcggtgtgcagttcgctcccggcaactacgccggagaagtaagcggcgcgcaaatcggtttactcaacctgtgtggcgggaatgtaaaaggaatacaaataggaatcatcaaccatagcaaggatactaccgcccataaactaggtttggtgaatatcactcccaaaacccgtatccagatgatgctgtttgcaggtaacaccagcaaactgaatgctgccgtgcgttttaaaaaccgccggagttataccatgctgggtatcggtacacactatctggatttgaatgacaaattttcgggctgtgtgttctaccgtgccggtctttactatcccatcgcctccaaactggaactaagtggcgacttaggttatttccatatagaaaactttgaaaatgaagatgcggaaacaccggaacgcatgtattcattgcaagcccgtatcaatctggaatataaattcaaatccagaatcagtttctttgcatcgggtggttacggcatgacgcgctactatgataaaaataagttctacgaaaaaaaacctattttcgaagcaggtgttatcttgttttaagcagccccgtcaccctagtataaactaatccatacagtatgaaactacagcatatcgcattagtctgcctgctggcattaagtgccgggaacgtcacagcccagatgctccaccgccccgattccatgtatacattcaccgatcctcgcctgcaaaaaaaacacccttggcgtgccgccgccgaaactttcggaatgaatgtcggagtatgggcattcgaccgttatgtaatgaacgaagactttgccaaaatcagtatcggcagcatacggcgcaatatcaagcatggttttgtatgggataacgaccaattctccaccaacctgttcgcccacccctatcacggaaatctttatttcaatgcagcacgcagcaacggacttaccttttgggaatcggctccatacgcctttgctggtagtttgatgtgggaaatagccgcagaagtggagccgcccgccatcaatgacctgatggcaaccaccctaggcggcatcgccctgggagaagtaacgcaccgtatgtcttctttggtactggacgactccaagcgtggtttctcacgtttcacccgcgagtttttgggaaccttgatctgccccatgcggggattgaaccgaatgataaccggcgagatgtggaaagtaaaacgctctcattacaaataccacgattacgaccgcattccggtacacttttccataggtgccggtgaccgttatctggccgatgacaattacctgttccgtggagagcacaatccctaccttgaattccgggtacaatacggagatgccttcgataaagtgaatgacggcccatacgattacttcaccgcgcgggccaccttcggtctttccgggaaccagcctcttatcagccagatcaacctgatgggcaaactatggggtgttcccctgaaaaccactaccggcatggaaatgatgttcggtatcttccagcacttcaactattttgattccgaggaagtgattgacggatcggggcgtatcccttacaagatttcggaagctgccagtgtgggaccgggtatgatttataaattcccccgaatgaacagcctggtaaatttggaacagcgtgtgttcctgagtgccatcctgctgggtggaagccttaccgactattacaacgtaatagaccgcaattacaatatgggaagcggatacagcataaagaacaacaccattctggacttcggccgttacggcatgttcgcactgaatatgcatctttaccagatttttacctggaaaggatacgaacacaaggatttggaaacaatagatccgctctatctgaatgcgcagggagacaaaggaaatgtaatgctcgctgtagtgaatccgattatcgagctgaatctaagctcccacttcaaagccaatatggaagtgtcctattactaccgccacacacattattcctaccatgaggacataaaatataagacctttgaaacccggctaggattgatttatcaattctaaagcaaggaagaacggacacggctcaaggtttcgggagtcatctgtaataaggaagcgatgtacacaagaggcgcacgcttcaatatttcgggatgaagctgcaacaatctgttataacgttcatgagccggttcaaaacgaagcgcgtccgccttcacctgtgactctatcaaagaatgttcgataaaaccgcgataaagacgttcgatatcgtgatattgatctatcaatttctccacttccacacggggtaactcccataccacggaggcttccaaagtttccaccatcaagcgggtggactcctgtttaaaataactctctatgcaaataatcattccgttctcataaccgatatgctcagtcagatctttatcatatttataataaaattgtctgagcattcctttttctataaacaacatcgatttacaaacctcaccggcctgcaaaacaatctcccctttacgatattttctacaaactaagatttcggctaatgcgtgaacactttctctactgagaggatggttaacttctgctatccttctagctatgtctatactagttgtcatgtgctcccaatttttgtatttgctgcaaaaatacaaaaaaggctggattattagacataaattacaaaattaaaccgataaagttctgaataatagttttttttatatacttttgaaacgcaatagtaataaaacgacctttatgaaactactagcctctttaacaatcctgggtttagtcatggcacaaagtgtcacagcccaaacgaattacacaaaggatccggaaagctgcactagcattatggtaggaaagaaagcaactaccgatggatcagttataaccagtcatacatgcgacagctggtaccgaacctgggtaaacatggttccggcagaaagttatgaaagggatactgtaatgaatatttacgatggccgtatgcataccgagtttgtagccgaccagactaatgtaaaaatcaaggggcaaataccacaagctagaaaaacatatgccttcatggacacctcctacccttgcatcaacgaaaagcagctggggataggtgaaactaccgtaagcggacgcagggatctggaaaatcccaaaggtatgtttatgattgaagaattgcaacgtgtggcattgcaacgctgtacaacagcccgtgaggctatccgcctgatgggagatctcataaaacaatacggttatggcgacagcggcgaatgtctgaccattgccgatcctgatgaagtatggcacttcgaagtcttcggagaaggaaaagataacattggcggagtatgggcggcagtccgtattccggatgatcatgtaggcgtatctgccaacatctcgcgaatcagcaccctcaatctgaaagatcccgaccactatatggcttccgaaaatgtatttgacgtggctaaaaaattaggatattgggatggaaaagagccttttaaattttggaaagcttatagcggaaagaattactccggccaactgaaatccttcagcacccgcgagcactttatcctgaatgcactggcaccgtcattaaagcttgattatgaagcagaagaactgcctatcagtgtaaaacccgacaagcaagtatctgtaaccgatgttatggcattgctccgggaaacatacgaaggaacgccgctggatatgacacagaatctgaaagttacggtaaaagatagaaaaaccggaaaagtagacaccattatcagcccgaaagccaatccgtggatgcgtggcgatgaactgaatatgctgaacggtattaaaaagggagttgtgaaatcagtacgcaatatcgcagttccgcaatgtgcttattctacagttatccaattgcgcaactggctgcccgatgcagtaggcggtgtggtatggttctctatggacaaccccggacaaagcccgcgcgttccggtattctgtggcattactgatttccctgctatgtataaaatctgcggtaaccaccgctatcgcgacgacgccgccttatggcactatcgccgcgccaacaaactggctgctgtaagatggggaactgcccgcaaagtaatggaaaaaaatattcgtcatttcgaggaaaaaggacaacgggaacttccatttgtggaagcacaataccaaagtatccttcaatctaaaggggaagaagcagcccgtgcttatctcacagactacacggcagactttataggcgccaccatacttcgctgggacgaaatggcaaaccaatattggattgagtcacgcttcggcttttaattgttaaccttatcatattaaaaacaaacttatgaagacaaaagtattcacactagccgcactgctatgctgtgcatcagccatgtatgcacaagaaagtggttacaaattcacgactgttgcatcacagaaagcaactccagtcaaaaatcaggcctctaccggaacttgctggtgctttgccaccacttcgttcatggaatccgaactgctccgtatgggcaaaggggaatatgatctttctgaaatgttcattgtacgccaaaagtacttgaaccaattggaagacaactattaccggggaggcaacgggaatttaggacaaggaagcctttcacacacatggaagaatgctttcaaccaagtgggtatcgtacccgaggaagtatatcacggaatcaactataactcagagaaacataaccatggcgaaatggtgagatatatcaacgctttaggaaacacagccgttaagatgaaacgtcgcagcccggaatactacaagctgatcaacaaccttttcgatacttatctaggagaacttcctgaaaagttcacttacaaaggaaaagagtacactccgaaatcttttgccgaaagtctgggtttgaacatggacgattatatcgaactgactagtttcactcacaaaccgtattaccagaaattctctccggaagtacccgacaattgggaaaatgaacaaatgtacaatcttccgctggacgaaatgatggaagttgccgactatgctttgacccacggatataccgtatgttgggacggtgatgtcagtgaaaaaggtttttcattcaaaaatggtgtagccatcaatccggtagtgaaaaaagcggaagatctctcgggttccgaccgtgcacgttttgagaaaatggaccctaaagaacaaagagagatgctggcggaagcctacaaatttgaaaaaccgtgtcccgaagtaaatgtcactccggaagtccgtcaggaaggttatgaagcatttgtcactacagatgaccacctgatgcatcttaccggtattaccaaagaccagaacgggaccaaatactatatcaccaaaaattcttggggtacagaacgcaatacatttggcggttatctgaatatgtccgaaagctatgtacgtgccaagactattttcctcatggtgcataaagatgctattccggctgcaatcaaacagaaattaggaattaaataaaaaagaaaagagcaggcgtccgtttttctaaaatagacgcccgttttttgaaaacagatatccggagtcccaatacatacttgtgttttcaaatggacatctattttttagtaaaagattcataataactatgacgaaaaagaacttatttacattagtcttatgcttattctgtttcggaaccacaactcatgcgcaacgtatccccacattggaggaggccgtatacggaggactgatcaagacagaaggcggaagtaacgtgaactggatgaaagatggagaacgttattccaaaatagagaaaaatgccgagggagcatacgaagtcactgcctacaaagcaaaggacaattccaaagaagtgctgatccctgccaatatgcttctgaatccgcaaacaggaaaacctatctctgtccgcaatttcgtattcagcgaggataactccaaagtattgatctataccaatacccgtcgcgtatggcgttatgatacccgcggtgattactgggtgcttaatttgaaagacggcaaactgcaacaattgggcaaaagcttgccggaagctaccttgatgttcgccaagttctcgccggatgccagccgggtagcatatgtctccagaaacaacatttatgtagagagtctggttgacgggaaaatcaaccaactaactcaagacggaaataatgaaattgtaaacggaacattcgactgggtatacgaagaagaattcaactgccgcgacggtttccgctggagtcccgacgggcaatacatagcctattggcaaagcgatacccaaggtacgggatggtttgatatcatcaataatgtagattccatttatcctaaaatccaacgttttccctaccctaaagccggaacagcaaactccgctgtaaaagtaggctatgtatcagccgacggtggaaacaccacttggctggctcttccaggtgatgcacgcaaccactatattccacgtatggaattcattccgggctgcaacgaactgttcatccagcaaatgaaccgtgcccaaaacaccaataaagtatggattgcgaaaataggtgaaaatacccccgtcaatatctttaccgatcaagatgccgcatggttggaaacgaatgacaatgtgcgttggttgaaagggaacaagtatttcacttgggaaagcgaacgtgacggatggcgccacctgtatcgtgtaagccgtgatggtaaagaaatcaagcccatcacccaaggagcttttgattatattcaagaagtaggtgcggatatggataaaggttttgtgtactttatcgcctctcccgacaacttcacccagcgctatctctaccgggcacgtcttttcggcaatggagaggtaaagcggctaagtcctgttgaccaaagcgggcaacatcgttatatcatgtcaccgtccggcaaatgggcagtccatacattcagtaactcggaaactccccctgtaatcgacatggtgtctttccctgcccataaaagtatacgtctgattactgacaatgcaaaagccaaggagcaatacaaagccttggggctgcaaccgaaagaatttgtaaaaacccgttcaggagaactggaactggatgcatggatgatcaaacccgtaaactttgatcccagcaaaaaatatccggtcataattgatgtctatggagaacctgccaacgccaccgtgcaggatgtatggagcggaggaagtttatggcaccagtacttggcaaacctggggtatatcatagtcagcatcgagaaccgtggtgccaatgcaccccgtggacgcgaatggcgcaaatgtatttatggagaagtcggaacctttgccagtgaagatcaggcaagaggcatccaagacttggcacgtcaatactctttcattgacaccgcacgcatcggtatcaccggctggagtggcggaggcagccagacgctgaacagtatgttccgttatcccgatgttttccacacaggtattgccattgcttttgtggccgaccagcgtctgtatgacacggtttatcaagaacgttatatgaatactcctcaaaataatccggagggttaccgcaaagggtctcccatctcgtatgcagcaggattgaaaggcaacttgctgttaattcacggtacaggagatgacaatgtccattatcagaattgtgaaatgttggtcaatgaactggtacggcacggaaaaatcttctcacagatttcttacccgatgcgttcccatggaatttacgaaggcgagggaaccagcttgcatctgcgaaagacaatggctgattactggctgaaaaacctgcctgccggaggaaaataaatatgccaaaattcctgctgatatgattatacagtcggccattctgaacattagtgaaacttttcatatacataaaatgattagagtccaaatttttcacaaaagttcgggatggcagactgataaaccgatttcgttttagcaagcttagcactaaacacataaactaaatgaagaaaatacaactattcttattacaatttctgttaaattcagtaactttatagccaactccttgtcggctatcgcggcatactgcttttttcgaaaaaacaatcgtttttttgtaatcggttggtagataagacttaaagagtagaaagttcggtagccggtagcgatttggtagctgtgcgggtttcgctgcattgcttcgctttgctcttggaactgatgcaaatatagggattttgaccgaaaaagggaaatgtttcgggggattttttatttttcgggattaccggattacaggaaaagcataaaagcaggaggcggtgcaagaaacgatgttgcaccagtggttttacaagaagtgtaaagtgttgattttcagtgtgtatttctgtggtgcaaggtgcagctatatttatatatatagctgcaccttgcaccagccatgaacggggtgttccgatagggcttggcggcttcgtgcttgccctgcgagggtttggcaggtgggtggctggaatgtcggatttagggcagtcttggggcttttattcaatcctttgccccttccggtcgatgtaataccaatcatcgctttcccaatagtggtattccccatccgaaccgggaacttctttctgttctcccgtgtcggttactttcgccttcccgttctcgaaaggaaagccaaaagcgaagcgtggctctatgagggtattgccatgctcgtccgcatatccgatatgccctttttcatcgacgatgcggtaaacgccttcctgcacggaatcgttgccgttgtcatacctgtacgggacataaaggcttgcgggatggctgttgccggaggatatggccgtgcagcggtcatgataaagggtgaacagccatatttcaagcaggatggcaaggactgcaagcaccgtgcagacaaggaaacggaggcgatagcgttgccgcaccgatacatggaacgccccgtaaaagtcgtgcatcatgcggtaacgctccccggtatagatgcgcatattcctccaaagcagtacggggaacggcagtatcagcgggaaaagcgtaaggcggttgtctgtctcgcagaggaagcggacagccggagtgtccaagaactgtaaaacaacggcgaccggaaacagaaggcaggcgaactgaaccacgctgatgaccgcaaaactacggtcagggaagccgtgccgacaactgcgccacgtccaataaaagaagtggtcgaagaatccggggagcttcggccgaccggttcttttatgtggggaggctttcttcatacgcttgcggctatataggtgcaaataaaacgtatttcttccaaacggaaaagaattttgcggtgaaactttttgagtgattggacttttcactatttttgctttgatgtataacggttcgtccgtaaggtatgaatttggctttttctgttattgttatggaatggttcgataagataagcgagtttatggagggtctgccggagtggttgcaggcgcatccgaggtacggctacctgatcgtggcgggaatcctgctgctgtggcttgtggggattgtctgcggatggcggtggacatactcccgtccgggaagttgggaggggaatttctggctgggtacgctgggtgaaaggagttaccgtttctggctggggctgatcgttgccgccgcagcgggatgcgccctgttgctgttcttcgtaacgggataagcaagcggaaaacaaggaaaggaggaagctatgttcaaggaagcggcatactggatgtattacttctggagcaagaacaaacgtgcaaggaaagacaaggcggttatcttcaatgccacgtggacgatggcaatcctgtggtttcttaacctgacggctctccatcttttgttcgaggcatggggatgggatatgctgacgggctggttctcttccctgacggacaaggtggaatggagcagattcaacccggttgcctacctgttcgccgcagcgatgctcgccccttttatctggattgccagaaagctgtattaccgtcctgcgaagctgaaagcgatgcaggcgaagtacgagacaatgggcgaataccggaaactgctcggtcaatgcctgttctggctgtatattaccggcagcttcgcatccttcttcatcatagccgaacaaaagaaccattccaaggagcaaccactgatcgaaaggttgcaggagatacgggacggtaaatatcccgttgaaaagacatactcaccgaccggcgaatgaccttcttccggctcccccctgcttactgtctcatgccgttctgcgggtggaaccggcacagcctttctgtttttcacgaccgaatatccgagcctatggagcaaaatccgaatccgcagcgcaaggacataccgtaaccgatgcaaagcaccggaagggtgcttgttgcagacaatttgtaatttcgtgtaagatttatgcaattaacattaaaattgaaacagaatgaaagagaatcttacacaaattctaatgaatgaagccatccgggagggatggcgggagtggatggcaaaggtgcggacggtattgccgcaaacggatgcggagcgtccggtaacatggattgcggcggaacggctcgcacgggatcacgggcggatggtccggctggtggagctgctcagggaacaccgccccgtcctttcctgccgtgtgcaggaagaagccggattgctgatactggtcgcctaccaccggcacggcagctcggcggatttcctgctggatacggcggaggcgtatttccgggagaaggactgcggaggattcctgttcctctgccggatgcaggcaagcatcaacgcctacgacgaatacccgcacctgaacgtgctctgcaaccgtctggcaggactgctgttccgcttccgccgtgaacgggagtccgagtaccgcaagggcatacccccgatgttcggcaaggcggacttgcaggaggtggaaaagtacctgccgcacctgcggggctgctctttccgggaagaggtcgcactggctctgcccaaggtgaaaaacgtggaggagctggcacgggaatgtgccatgtcggtcaatacgctgggacggcggttcagggaggagctgaacacgactccgcaccgctggctgacggaacagcggaaggcgcacgtggtctccctgctggcggacacggacatgcccttccaagagattgccgacgtgtgcggcttcgccactccgagttacctgtgggacttctgcaagaagcacctgaaggctacccctgccgaaatccgtgaaatcgcccggtgcgcccgtcccgtccggcatccttttccggttcagaagtgaggggctgaccgcccgcagccgattggcggacaatccgaacacggcggtgaaaattcagaacgcccgtttcccggcaccccgctaactttgcttccttataaacaacccgagacagaatcatgatggaagaatatttcaatacattgttgcaggagacggagcggcgcatggctgccgctgccgccggcatggagggaaaagaaacggtcgccacctgccgggagatggtttcgtacctgaaagccaagaaccgtgagctgaaagcgtatgcgctcgcccgtccgttcagcggggacgaggaggaaatccgttacttcaaatactacaagcccgccctgacgggtaggctgctgtactattaccgggtatatcaaatagagagcggctgtcccggctgcctgcgggtagccgaaacgtactaccacagggcgatggaacgagccgagcggatgatggaacgctacctgcccttctaccagtattaccacagcggggcgacataccgggacgattactatttcctgcgggcgaagggcgaactcagccctgaaagcggcagcttcgtgctggacgaggaagcggagttctccacgggctacgacatactggcggcacgcctgatctcggtggagatgctgctggtctatctgagccgccggatagagcgtgcggcacgaggggacggtacggaagccgtgccggggaaggaacaccgctggacagacacgaaaatcgccgccatacagcttgtttacggcatccatgccgccgggagcgtggacaacggcaacgccgagatcggcgagctggctgtgctgttcgagaagaccttccatgtggatctgggcaacgtgtaccatgctttcggcaggctgcggggacagcagaacccgacggcgttcttggacgagatgaaggagaagctgctgaagaagatgcgggacatggacagcaagtaatcggcaagtcggcagcaagttggcaacggagcggcagagacggcaggagatgaaaagagagcgtccggagggcagaaaagagcctttcggacgctcttttttgcttcgatgtcagttcctttccgccttgtttttacgttgacactactctttccttgcctttttcagtcttttcagcctttttgttgcccggaaaggtggacggaagggcggcgagggtgaaaaaagaggatgaaaaaatacgcatcagaaaaaaatctttgccaaggtgccggtatggtggcaggaaaaaccggcgaatcgggcgacatttgcggcagaaacctaaaaaagagtacgacaatggaaataatgaccatcgagagcaacgcctaccgcctgctcgtggagaagatcgagaagataaccgcctatgtggaggaatcccggaaccgggaggaaacggagcgcaaacggaaagaggaagcggaaagccctgccgccaagggacggaaagccgacccgaagtggatgacgcacaaggaggtgtgcgagatgctggacatcagccaccgcaccctgcaacgctaccggcagaagcatatcattccctattccatgatcgggcggcagatacgctatccccggcaggcggtcgagagcctgcgagagcggtggatggtggagacacccgccgccaagatcgaccggatgatagcggaacatcccctgcataaccgaaaaaacggcaactatggtaaaaaaggaagagatactggcaagaaccagtaacgggctggatgtgttccgccactacctgcccgtgaagtggcgggtgggcaggaacttcctgaacccgctgtacgccgacagcaaggcttcgtgcaacgtgtattacgaccgccggagcggtacgtaccggatgaaggacttcggcaacggggactattcgggcgactgtttcttcctcgtggcgaagctgaaagggctggactgccggaacgccgccgacttcgtggaggtgctgcacaccatcgaccgggagctgtgcctcggtctggaggatgacagcccggaagatacagccgttccggacggcggctgccgtaccctgcggctcgtgccgggcgcaagggagaatgggacaagggagaaccggagcggtgaaggaatatccgtcagggcaaacgggaacggcacgggaaagccggacaggtacacggaagaggcggctgcgccctttgacagtcccgaaccgaagccctatcggacgacggaaaagccgtttacggatgcggagcttgcctactggggcgcatcgggcatcacggaagagctgttgctccgttacggggcggtatcgctcgccgagtaccggggcgagacgagggagggcaagtcgttcggcttcagttccaccccggcggaaccgatgttcggctacaaggggaaatggggcgtgaaggtctatcgcccgatgtcggaggtgcgcttcgtctatggcgggcatacgggcgacaactattgtttcggactggaacaactgccctcgaagggcgacctgctcttcctcacgggcggcgagaaggacgtgctgacgctggcggcgcacggcttccatgccatctgcttcaactcggagacctcggtcatcccggcgaaaaccgtgcgcaagctggtctatcgcttcaagcacatcgtgttgctgtacgacacggacaagacggggctggagtgctcggagaagcaccgtgcgcaactgtcggagtacggggtgaaacggctggtgctgccgctgccggggacgaaggcggagaaggacgtgacggactacttcaaagccgggcacacgagggaggagctgatggggctgttcctgaaactgctcgacacgctgtacggggagacgatggcggtgctgaaatcgtgcgagatcgactacgaccacccgcccgaacaggctgtcgccatcgttaccgccggggaggtgccgttaggctcggaggagaacatcctctgcatcacgggcggcgaagggacgggcaagagcaactacaccgccgcactggtcgccggggcgatcatggaacgggagacggacgccgacctcttgggggtgcgggtggagccgaaccgcaaggggcgtgcggtactgctgtacgacacggaacagagcgagcaacagctctacaagaacacggggcggctgctgcgccgtgccgggcgtgagcggatgccggagtacctgcacgtatattgcctgacgggaatgtcgagaagtgagcggctgaccgccatcgtgcagagcatggacaagtaccactacctgcacgggggcatccatttagtcgtcatcgacggggtggctgacctgatccgctgcgccaacgacgaggcggagagcgtggcgctgattgacgagatctaccggctggcgggaatctatcgcacgtgcatagccgccgtggtgcatttcgtaccgaacggtctgaaactgaggggacacctcggcagcgagctgcaacgcaagtccgccgccatcctctccatcgagaaggacgagaacccggaggtgtcggtggtgaaggcgttgaaggtcagggacggcagcccgctggacatccccctgatgcagttcagatgggacaagcaagccgggatgcccgtctatgtgggcgagaagccgagggcggagaaagagaagcgcaaggagaaggagctggcggagatggcacgggaggcgttcgcccggcaggagaagtacggctacatcgaactgtgcgagctgatacaggagatgctggaagtgaaggaacggacggcgaaaggctacatccgctatatgcgggaaaaggaaatcatcgaaaaggagggcgactgctatgtacacggacagggaagagtttgagggctggatggagcgcatcatggaacgcttcgaccggacggagaaattgctggaaagggtgctgaagaagaacaacacgctcgacggcgaggaggtgctggacaaccaagacctatgcctgctgctgaaggtgggcatccgcacgctgcaacgttaccgtgccatcggggtgctgccgtacttcaccatcagcggcaaggtgttctaccgcacgaaggacgtgcacgagttcatccgcacccgcttcgccgaagtggaggaacgggctgcgaaacgcaaggagaaagaagcccggaaagcggaaagacgcaggaaaagggggctgttcccgtgagaatgacatttttctgacggtgctttaggtggatgaagccctgccggatcgtgagattaggcggggctattgttttgttattcgggaagtttcactatctttgccatgcgaagataggatgcggcttggcattgctctcgcctttcgctatctttgcgatgcaaaggcagaggacggttctttcgggtacggtcgctgtcgtgacatagaagattcatacccggcttggaagcaggcggggttgatatacatattgtacgttcgctgaacgtcttggaatagaaaactggcacttttcaaaaaagacaagatgtgtagcgcaatgttcatgctgtatgcttatacggcgtggacttgcctattctgtctttttaggtatgccagtacctctattccggaatagcgtgagttcacgctgttcttttgggtgcaaggcggacataatccttaaaaacttattgacatgaaacagattaccttgcacgtgtaccagtctcttgacggttgtccggtcggagcggacaagcatttcgatgcggcggcggatgcctcctgctgcgtgctgatcgacgaagaaacctacctgcgcatttacctgaaccatctgggctggccgctcacggcaaaagagactttggtcgtgacgggcggctgtatcgacctgacagagaaggaacgggtgcggtttgttacaggggatgcggcagcggaactgcggagaataaaagcggacggcgaaggtacggtaacggcttacggagcggaaaccgaggctttgctcttggataacgggctggcggacgaaatcgtggtgataaccgtgccggtgctggtcggcggcggtgagaaggcactggagtgcgggctgaacgacgtcaggacatgggtcgtgcggtcgagcaaggtattggaggacgggaaaatccggacggtgtacggaaaggtgtgcccgtgaaatgcaaaaagccgctgaaaagcggctcaggtcattcaggaaagggcgacgggttataaaaaaaacgacccgccgatttgagcattttcactgttgttcaacaactcgtgtcaagaggcttggcaggttctactggtacaaagataaggtaaattctttgaaagacaacgggaatatataacaaaagtgcgacaatcggttgccgcactcttataaaagacttacccaaagtacgctgaacaagcgagaagcgaggtaagtatgttaatcgttctaagccgggataagttgatacgggttcgctatcgtcttacgaccgtagtttttcagcagcgaaaccaaatcctgtctttctgtacctttgggagcttggagttgtgcccggctcggtatgcgggaaacaaagaagggccacaactcgctggatgagtattctttatctaccgtcgggaaatttaccaacggcaggatgtctccctgcctcttgaactcttccgagtaagagaaaaaccaaacattatcggcatacgacaacgtaccgacctccagtttgttcaatgtcaagatgaagtcagcctgccctttgcccgaatgaatagcctgttttttcatcgttctattcatttattataatttcattatagtggtattctaaagtagaataaaaaacgacccgcctatttgagcattatcaagaggcttggcgggttctattggtgcaaagataaggtaaattctttgaaagacaaaagaatactaaatttaggtaataccgtagcctaaatttgaggtacaaaataacaaaggtgcatcattgatgcacctttgttatataatatgtaactgacaaacattacaatgccgttggcaatgactgagtgtcaataattctctttttgtaaaagattttttggaaagaagacaatacactactgtcaatccatttagaatgtgaagcaaaaaaagtatcggcaaccttgatatattctttgggagcttcacattttctcaatgaattggaaattaacatcatccctttaagtttagacttaaagaatctattttttaatccattgcggtacagaaaatcaaaatagacctctgcatcggcaatgttgagatttgccaattcagtctgaagctctttccagtagtagttcgtcatttctgacgataaaataaccactaacaagctccgtccttgcaaggggattatttgaaattctttattttccattttaccaattattacatatattattaataataacaaggcagtccttaataatgtttacggcttcatcgtattcaagggttctacttgtttccacattaaaactgtccacatggaatgtcgagtgcctatgttgattgaagaatgaatatccttgttccaaagcctgcttcaaatgtagattgttgtcatacgttccgataccacttttaaagcaatacgccccactattatttttctgaaaatatgtcccgtattcgtcaaaatcaggcgcatcttccaaaagacgagtgcgcaataccgcatctaacgctttcaaaatgccaaaagtataacatccataatcatccaccttaaccgcagagttagccaaattgattgaagtattgataaagttttctatcacacttccatcaatatgctctctgtttccaatatacttgctaagatcgttgtctaatgcatagccagcacgtgcttggatagcaaacacttcttctatagcttcggaaggaatggaagatatagcttgcaacacttcggttataaattccacataaaatgatgtgatacatccttgtaccattaatgttccgttattataaaagataacagaaaccttagcatcgtatttccctttcagatgatattggttccggatgttcggactcttatccgtgtttacttcggaaacaacaacattattatattcttttaccgctgaaatcaatgtatcaaaatcatcgctccttacacctttcaatttgaagcatttttgatccatatccggtatcgcagtctgttccacaatatactcccaacaatccttgcaaattccattcaaagttccatttttgccttgtatattatgagaaacttgtccaccagtaataaaacaatttaatgtgcttttttcctgattttttatattgataatctctatctgcttttgctttccttggttacattcctttatgtgaagcgtataagcagggcgggcagcaataaattcttttgctacttcatctattttctcaatagccagagagtattttttagtcgccattacattcaaattggtctgcaaagttatacattttatttatattacaatgtagatcagtatattattaactatattattaatttacaagagaactacatggttgttttttaacaattgtgcttaaaagcctttacgggtacaagatcttgaaatcccgtgggctgccgccgtctgtcaagccgtcctgccggagccgccggagggtctcggctgccgatccgctgccgaagttgcggacacagtacaggcgggagaagcggaagcggtggaggtggacgagcaggtgctccacggtgaagacgcccaactcccggcacgcccggacgatgcgctgcgacaagccgaaggtgtcgagcggggtatcgagcaggcggcggagcctgcccggtctgccgggcttgccccgctgttgcgccacgtcttcgtagatggtggcgacccggttgcggctgaacagggcggcaagggatgcgccgtcgatcatcaggatgccgtcgaaacgggcgtaggcgatgtggttgccgttcatccagagggtgatgcgcagctcgtccgtgccgcagagccgggcggcttccgccacggtgatccaaccgatgccgttcatcgcctgcgctcctttcctttgggcttgtccgtgcggggcgggaacccgtacacggtgcggaagtccttgtcgaaggtgaggtacgcatcgaagggcttgccgtccctgctcctgaagcctttgataagggatgttttgcctttggtcacgaggtcggcaatctggctgtcggtgagctgcttctcccccttgttgcggaagacggtaagcccacaatcgacgttgctgcacttggcgaccttcgggtaaaggaggatgcgaccggaacggcacttgggacacgggatatgtccgccgtccgccaccgatacctgcacttgcaggagttcttcggtaatctgggcggcatagacctcgatgcccttgcggaaggtgtcgggattcatctccccgctctcgatcttggcgagggcggtctcccactgcccggtcatctcgacatcggcgatgcgcttgtccttcactatctggtacacggcaagccccttgccggtcggtacgaggctcttcttctcccggcgcacgtagtcccgggcaaagagggtctcgatgatggaggcacgggtggcgggcgtgccgatgccgttccctttcaggctgtcccgcagctcgtcgtctcgcaactccctgccgcaatgctccatcgccgaaaggaggctgctctcggtgtgcaggggacggggcttggtctgtttctccacgcactccgccgattgcagggggaaagcctcgccgggctgcaagggcggcaaagcggctgtaccctcgtcgtcctcgtcccgctcgccacgcacggcacgccatccggcagacctgacgaccgttcccttggcggtgaacacgctgtttcccgccgtgaaggagacggtggtaacatccttgaggcaacgggcggagaaggcttcgagcaggcgggcggctaccatgtcgtacaccgtgcgctcgtcggcggacagctcgccgggcagacactcggtgatgatgagcgcatggtggtcggtaactttccccgcatccacgctgcggcggttgagcgaagctcctttcagggcggcggcatgggcggcgaaagccgggtaccgcttcagcagtgcgatgcggtcgggtatctcgtcgaacacatcgtccgagaggtagcgggagccggtacggggatagctcaacaccttcttctcgtaaagcgactgggcgacggagagggtcttgtccgccgagaagccgtacctgccgttcgcctctttctgcaaggcggtcagatcgtagagcaagggaggctcttggctcacttccctgcgctgcacgtcggcaacctgcaccgtccccgttgcggtaacagcggcgagggcggcgtttgccgccggaagggtttcgtaacgcaattcagagatggcggcgaagggcgtgccgtccttttccgccgtaaccttcagccggaaataggtctgcggggtgaaatccctgttctccagataacgggagcaaatcatcatcaaggtgggcgtctgcacccgtccgagggagtagatgccctgcccggcggcgatggaaagcgcttgagtcgcattcaatccaatctcccagtcggcgatggcacgggcttcggcggcacggtagaggttgtcgtagtcgctgccgggtctgaggttgtccagcccttcccggatggcacggtcggtcagcgaggagatccagaggcgcaggcagggtttgcggcagccaaggtaattgtagatgtaccgatgaatggcttcgccctcacgcccggcatcggtcgccacgacgatacggtcggaacggtcgaaaacctccctgatgaccttcaactgtttgagtacgccggggtcgggcttgtactccttgccctcccgtatctggcggggaacgtacttgaactcctgcggcagaatgggcaggttctcacgccggaagcccgtgtagccgtatgcttcgggcatggcgagctggacgagatggccgaacgcccaggtaacgaggtagccgttacctgagaggtagccatcgtgccgctcccggacattcaacacgtttgctatatccttcgctacggaaggcttttcagcgatgactgctgtaatcatatttctttaatttttaacggtttgacaaaagttatcccgccgatcggacgggataaccggtaattcatttacagaatggcgggggaaatcagcggcggacaccccggttgcgcttaggcttgtcgggctgctcctgcttctgtgcctgtttccggtcctctttctgctcctgcctgcgctcctgctgctgtttctgctccccggtgggtcgctgctgtgcggattgcagggcttctttcaggttgcgggtcgtctcgacggtcttgccctcggaattgaccgccacctgcacctcgttctccacggcgggcttgacacgcccctcttcgagcgccgcattgtagtccttggggaacatgaaggcgggcttctcgccgggcttccatgtgatgtagccttggtaggcttttcctttcttgtccaccagaccggaaaccttgaccgttcccccggcttcgagttcgaggcgggacttctcggtaagctcctgcttgcggaaagtcttcggcacctcctgattggcggtctgtttcaggttcgccttgtacgcatccatcgccagcctaccccggtcgccgaagagaaattcgagctgcatcttggctgcgctgaactgcacgggagccggatagatcttgggctgctccccctccttggctctggaaaggaaccggcagaccaccgcctcgccctgtttgagccgggctatctcgtccggggtgaaggtatgcccgttcttctccgccgggatattgaccttggagagcgggaaggcgaccagctcgttggtcttgaggttgcggctgacaagggcttcgacctgctcgcccgcccggttggtgacggtcgccgggtgtcccatgttgcccgtctgccggagcacctgcttgtcggagtcggtgatgtcgtagccgaagaactgcttctgcatcttctccgggtcgaggatgccgtggctgcacacggtcagcctgccgtccgtgccgggcttgagcgagagctggctgtcgttgctgtgcgagatgccgtcgaagtggaaatgcacccggacggtcttgtcggtctggaagccccggagcatctggtcaagcatcccgttgccctcgatctgctcccgctgcacgccaagtgcggcgaggctgttccagtcgatgtcctccgggcggtacttgtactgcgggttctgttcggtctgcccggcggactgctgcggtgcaccctcgggctgttgctgctgcccggcttgggtctgctgctgtgcctgcacgggcggctgcacctcgtactgtgcgaggagcggttcgcctgtcttgacggaccggctctccctctgccggaaatcggcggctacccgctgcacctcctcttccggcacacggaagaagtggaagcgggtcgggtctttcaactggctccagaggttggaaaagaaatttgaaaacatatcgccgtggcgatccacccgcaggaggtcgttgttgtcctccaaggggttcttggtctgtaactcgccgtcctttactccgctgacggcttggagcgtgcctttctcgtccatgacgagcaggatgtccatcaactgctggctgctgtccggtcgttcgtccataatctgaaaaatttaaatggtgaatactattggttctcaaacgaaaccgggcgtaaatatagagggagaaacacgggaaacctgcaagtccggtgcgggctgtccgcacttgtcttctggttcgcaggtttgtcgccgccctttcctgtgaaaaatacaaaaaaatccatgtcatccacacatttttctatcccgaaaacgaggacaatccgttgttttcgttatatttggaacctaaatataggtgcggtcatgccgtacctgattgaaaatccggtaacgggaaacacgctttgtcgttgccacccatgcgatgcgtatgaaagtctatcagagcaaaccgagaataaaactttcacctgccatccgtgacgggcagaaatacgtggaagtggagttcgacgaggacgatgccatccggctgtcgttgtcgaaagagaagggcgtgcggttcgagggggacagagcctacctgccggaagaagggttcgacctgtccggttttttcgaccgccatgtggaaacggcgtttattgattactccgccctgaaaaacacccagcccaagaagagcgggaaaaccagccccgccatcccgcccggctatgccgaaacgctgcggcaactgcggtacagcgagcataccgtccgtgcgtacaccgcctatttcaaggagttccagcaatactttgcgggaaggaatctccgctacatccgaccggaagaaattaacgcctacatcgtgcacctgattgacacacggggaatctcgtcgtgccaacagaacctgcgcatcaattcgatcaagttttatttcgagaaggtactgggattggaacggaaatgttacgaggtaaagcgagccaaacgggaacggacgctgcccgacgtgctgagcaaggaggagataaaatccatccttgacgcaaccggtccggacatccggctgttctgcatgttctcgctgctctactccgccgggttgagaatcagcgagctgctggacttgaagccccacgacatcaacgtgagccgttcgctgatacgggtacggcagggcaaagggaggaaagaccgctacacgctgctgtcgaagccccttgtcaggaagctgaccgagtacaccaagctgtacaagccgcaggaatggctgttcgagcggtacaagggcgaaccgttcacggagagcatcgtgtcgaagaagctgaaagaggcggcgaaggaagccggaatcaccaagcgggtgtacccccacctgttgcgacactcgtttgccacgcatctgatcgagcaaggcacggacttgaaaatcgtaaaagagctgttggggcataaccaactgaaaacgacggaaatgtacgtgcacatagccgacactttcaagagcagcatccgcactccattggatgatattcttgaaggtgataatgagatagttaaataagaaaataacagcgaaaaccgctgataattacatgttcaaggccttgaagttactattagactgtataataggcagttgcaaacaggaaagatgatagatttactcgacatatcggcacaatcggaaggctgcggcactgaaaagaagtaccgcttggcagactatttcaaccgttggtgggatgagtacgccaagcatccggcagagtatatcacccccgaacaatacaaggcggcaaacgccatccgtgtatgccgcaccgccgctttggggatagatacttatgcctgccccgaatgtggtgaagtccgggaaatctaccatagctgcaagaaccgtttctgccccacgtgcggatggcgtgacacgctcaaatgggctgcacgcatgaaagacaagctgttgcgtgtccctcaccgccacgtggtgatgaccctgccccatgtattgcttgacttggtgaagcgcaacaagaaagaaatgctcaacatcatgatgcgcacatcggcggaagcgttgaaaatctggatgatgaaggctttcgggctgaaagtgggcgtgatagccgtgctacatacctacggggaaaccaagcagtaccatgtccacacgcacatgatcctgtcatggggtggcattgacgggaacgggaggattgtcgttccggaaaggtcaaaggtgaacgacgctttcatcaggagcatattcaaacacacgttcgataaggctctgatagagttgtttgacaacggaaagctcaaacatggcttccgcaaccgcatggagttcatgagttttatcaaacacgtggtaaacaagaagcagtggattgttcatctggagccgcctctggaaatgcccgaacaggtgatacaatatatcgggcggtattccaaaagagcgtgcctgagcgaatataaaatcacggcgatggaagacgagaacatcacgttccgttaccgtgactatcaaaactcccccgacaggaggaacccgttggagaaggaactgaccctgcattaccgtgagttctttccccggttgatgcagcatgtacccctacattatttccgtatcgtgaggtactacggcttttactccaacaaaggcaatttgccgggggaatacttcggacgggacgagaatgtgatgcaaaacgccccggcagaagaaagcgattacgagaatcctttcttctgcgagtgctgccaacgtgcgagaatttatgtacatacaataataacaagacgaacggttttcgatgaatcacctgaaacacttgtgtttagcaggtctgacatacgaaaacaaaaagtcgcataatgaaataacgggatagctatgcactttcgtaaaggaaaacatggaaatcccacgaaaaagcaatgaaaggaggacaaaaaatgattggtgaacggaacatcataccgggaaaatcccggaaacggaatgaaaatttcccttatcggcaaaaggaaagtgcagggggaaaattgaagttctataatattaattataaggtaagcaacctgaacggttgcttggagagttaaataaagcagcctaagggctgcgaaatgcggcctcgaacataaggataaatcgccccaaaaggcgattatcctccttaacattatgtgccacaaaaaaagaaaatgagaatatgaaacaagaatttgaaggttttgattttacaaacttttgggatgataattactatgcccgcaaggagtatatcagtgatgccccaactgatgaattgatagctgatgtagagaaagaattaggatacaagttgccagcttcctatatatggctgatgaagcagcataatggaggcatccctttcaatacatgcttccctactgattcacccacaaattgggctgaagaccatattgctataactggcatttacggtataggtagggaaaaggactattcactatgtggagaaattggcagtcagtttatgattgatgaatggggatatccggaaataggtgtggctatttgtgactgtccgagtgctgggcatgatatgattttcttggattatcgagaatgtggtccattcggagaaccaaaagttgtgcatatcgatcaagaatcagatttcaaaataactacattagcagaaaattttgaggattttatacgagggcttgaaaatgctgagaaatatgaggaatagtaagtaaggcacataacaagcggaagaatctccctaaatggtcgattatccgccgaacattatctgcatagaaaaaaatgaaaaaaatagaagaaataaaaaaacaattggttaaaagggcaactggttttataaccgggggatttagacctacaaattccaatactgaaagttggattggtcaagtgtatctatatagagaaagtgaagatataccgatagatagcaatggtaaagcaatgttgccattgttacaaatatgtcttgaagggttgccctatattcctgatgcacttaaagggtcgaaagtattgactgtttttgtgtctgaaaatatgcccggcagactggcatataacggagatgattgggttattcgtgaatacaaagaagaagatgtgttggttgttaaggatatacacatgcaatcatcgttacgcataaagccctatccgctgaaaagccaactaattactgaagattatcctgtatgggatagtggcgacattccaatggatatagaagatgagttggtggaaatggaagattccggggaaatcaccgactattatgactatacggattgttttgccgggcataaaataggcggttatcctaattatatacagtcaggtatagatttcggtgatggatatgaatttatgattcagatagcttcagatgaaaaagcgaaccttaatatcatagatagcggaaatttctatttggcaaaaaacagtcaaactggagattggaggctttattgtgatttttattagtaaatgcagataacaagcgaatcaatctccttaaaggtcgattattcatcgaacattagccaccaccaataaatggaaatgattgaagaaactttaagaactgaatttgaagcattgaaaaatgactttgaaaccataaggcaacaaatagaaagcgatgttgtcagaactgagtggtataagggcgagttttatgagcttaccccatattcctatcagcgtaatggtttcagacaaggaaaaactgtaaagcgtcctgatacagtaaaaagcaccaaaaatctttgtatctatggatttaataatcaaaatcaaatagtcgaagttaaggttggttgttcgattgaaaatcagttttatcacactttcctatattatacagacaatcttgtgaaaagtattctatatgataatggtaaacatttgatgaatgtatgccatcactttttcgagagcggaaagttgaaacagttacagttatgtggtagtcatggcagccgtgaagaaaattatatctataaagaaaacgctttgacacatattgaaatcaaacaatatgatattgatggtaaaagtagtagtgatttagttcacatattccaatatcaggacgatggggatttagaaagtattaccaaatcattttcaaatggatattctgaaataatctataaaacgaaaaaaggttgctaacaagcggattaatcaccccgaaaggtcggttatccgccggacattagtttgatttttaacatgaaagcagaagaattacgaatagcaataagaaatgtattagaacaagggtttatttcaactttatccaaatatggatacagctggaacaaatctaagatgtgttttcatcgtaaagtaggagatttcaagcaaacgattcttatcaattcttctgttaatcctcgattcactaatggcataggctatataagtattcatttattctataattcgtcaaaaattgaaaagatggcttctgttctgatagatgccaaaacagattttgagaaagttggaattgtgcttaatattaattcaggttttatttctggaaaagggtctgtatcgtttgacttgttatcattagatgatcttctaaatgtatttaatcttaataatatgccattcaaggaaatattaagtttccttaatgaaagaacaacaatccaagatttacttatggattttgagaataataaagattatatttggtggaattctaaagatcattctatccttatgataattacgatgtattatatcactggtaatgagaaaaaagccaaagaactcgctatatcttattatcaaaatgataaatgtgggagatggtataaaaatgtattacgatatttcgaagaatcaaataattttcaaactaacaaacagcaaaccgactgaacaagcggaacgctgtcaaacattatcggctcaataaaatgttcaatttttaattagaagaaaaatgaatactaaaacaaatgatttaaaagaaattatcaaaagttggatcatcaatattgataaaacagaagaattgccttctgatattgtggctttgagctttaatctttatgaaccttatggtttagaaatggttggttctacttggtttgatgaaaaggatgaagattgggcatgtgatgaaacttttgaaccagctcaaagaagttgtcctaattttgaaatttcagacaaactaaaatgggaagaagtgttagaaatagttgtagctattcttaaagacttactcaatgaacttgctgacttaaatatttttagagtagaacatatcgcagttggatttgtagatggtgatttgattatcattaaataatcaatatgccgataacacgcaccgcaatcgcctaaacggtgattagctgccgaacattatcaatcacgaaagaaaaaatgaagatttcggaatttagacaacgatatattgaagcaatgaaaatgtcagaacggtcaaagattgctgaattgttccgactggcagatgatttggaatctgttgaaaagacagaagagaattatcgcatattgagcgatgtatttagctatttaggctattatacaaaagcctatcattatctatcagaggttgccaatcctcaagacatgaaagatgctaagaaattgtaccatcttaaagatcgcttagaatgtgaaggtgatagatacgcctcaaaacgtcctcgaaaggcgaaagactgttctatcaaaatgccgaactttaaatattgttctcaaccgttggaagctggagtgtttgaaaaggttgatacaccggaagtatgtgattgctgtggaaaaggaacatctgtaatatattccggtcctttttatagcgttgaagatataaatgttctttgtccgaaatgtattgcttcgggtaaagcatcaaaaagatttgatggcgaatttgtggattatgcaattctttcctctactatttcagaagaatacaaaaaagaattatgttgccgaacaccatcctacaatgggtggcaacaagaatattggcctgaccattgtggggatttctgtgaatttatcgcctatgtcggttggaaagaaattgtagaaatgggattagaaaattcgattgagtttacttctgaatcagaaggctattcagaacataaagaacacatcatcaatggtagttcatgtcaaggttatttatttcgttgtctgaattgtaagaaatatatcctctatgtggattgtgattaaagagattgataacaaacagcactaccgactgaataagcggaacgctgccgaacattaccgataagaatgaatacgaaagaacttattagaaaattggagcaaatgacagagctatcggaaagtaggaatgagttttataagaagctaatacattcttccagaatgatgctgatccacaaatctatgataagatatattctaatctttgcggattattagcgcatggagatttgaataataaagaatatgacttactgaaagaagttttatatgaattagaagaaaggatataagaattaaaataatttatcggtaacatgcacctcaatcgccccaaaggcggttagccaccaaacattagcaaccttgtgaatatcaaaatatggatataataagaaatgataaaatagtagaaataaaagatatgctgtttgataagttaaaacaggatatatcttttttagagaaacgaataacgatacaagaacgctccgtttcaaattggaaatatgcaacggatgaattttatactctaattccatttgaaaaggaactaaataagatgaagaaaggacgcatcttgaaaaatattcaatttgacgaaagatttgcttctccttatattttctccttcggcttttctaaagaagaaaaacttttattgacacaacattcattaggaaaagattttggcattatttcacaagtttacgattatcacaatagcggatgtatagagtatttcattctacgatcttatccgtctaaaaagtataatagcaaattagtatcaataggtattctttttcaaatcaatgatttattacaagcacatgtatgcgtatcagataataaacataattggagtacaactgcctatcatgtaggcaacgaaaataaagtcgataaaattttcagatatgcttcaggttggaataatcaaacggaatatgatttagaatacgttgataataaactcaataagataaaaataggaaatgtagtttggtggaaatctaaaaaataggttactaacaagcagcaaaccgactgaataagcggaacgctgtcaaacattactaacttgtaagaaatatggtaaatcgaatagaaattgaaagactacttcaaagtaaagaattaaaagaactatggcaaacaattcaacaagagttgccacaactttatttttgtaaagaaaatgactcttgggaggaagcacgaattgataaccttgaagattacatctccgaatgtaatactttgctctgtaagtgtaactttcaagaattatcaataaaagatttatatacttatcttttatcggatagttttagggctttttgcaaatacgtgcttttagagtgggaaaacgaagaaattgttatagatgagtcggagcgagattatatattaaatgaacttgaaatctcggaagacgaatataagcagcgttgtaaaacgcatgattatcttgatgttgcaaattgtttaatagattattatttactgaataagcatccggatattttacttgaatattataaaatgcaaggatataaagaatcggaacagatgttcaaagataaaatgaatctctattcgatgtgtaaacattagtaacaaacagcactactgcttaaagcggaacgctgccgaacattataataaataaaaatcaaagcattatggcaaaatatgagttgggggcaatttataaaattaatggtcgaagtggtgaattgtattatgtaagacttttgacaaacgactgttatggcgttttttcatcattagaaggcgaactgaatgaagagacatttgctcaaacccattatcgtctctattttagctgtaactcttttcctataaaacgaggtatatgggaaaaagtcgtatcatctccaaactgtacagatattgcacggtggcaacgccctcaatatttagctaattttgctaatttcaacatgaaattatttcttgatcaatgtagagtttttcatgaagatgggaacctttatcaatgtgaaagtaaagaggagtttattagattagtaaaatccggtaagattttattttgttttaatacttatgaaattataccagactttctaatgaggtattacaaggatttccccaatagctatattgtaaataaagattttatccatagtggaactttggaataccaaaaagaacaaacaaatgtattaaaagaattaggctttgatattggaaacttattataacaagcggctgaacattcctataaaggttagttagccaccaaacattagcatcaaatagaaaggaaatgaaaacgataaaagaattacttgatatagttattactttggaagataatcctcaaacaagtaaggttatcgactttcacaagggtgtgccgactcttgaaagtggtgtttatagaaaagcctctcctatgttgaaagtcaggtatgagttattcggtaaatggctaaatgccacacatggagattggcttgatacggaagaaatggaaagtttttggagtgaaggtgcagatgatgaacggttggctggaattgttcgaaatgtaaaagcctcaatgggtaattgggaagatcatgcaaccgggttatttgcacttaacagagtttctatttttgccgcaagtgataacagttatgaaatgatttgtctaatctggtttgacggtacggaagaaccggaattatgggtgtatgattgtaatggcgaaagtcgatataaagacttggcttcctatttgcaagcatatatagatgatgatgtttcggcttctgccgtgaaatggaaattagccgatatgtaagtaatcccagagatagaaccgatgcttattctcctgccgtttatcatgcccaatgtataaatccaaggtgaaacatcagtgcgacattcaccacggtcagggtgatagcgataaggactattttggcgagcttcctgccgggatgtttcatctttccgtaatattcacggagcgcttcacgccgcccggctgtgtagcggagttgacagaataagtcgggaagaaagcagagcattatcaatacgacaaaagcaacaatccaactgaaatagcgaaacatcaacggtgttccaagcggtacgagtatggcaaagagccagcaaaagaacaacagcatacgcccgttaaggttggtatgctccctttcgtgccatatctcggctacataccacatatagtcgatgaagcagacccggtatttgcgattgtccttatccatcttgttacaaaaataatgttttctacctacttaaccattacttcatgccgaaaaacaccatacccgataaaaaatacctcgtcggcttgttcttgccgacggggtgtttttatcctcacttgtccttaatcagatgcgacagctccgggtctgccttgatgcgctcaatttcgtcggcgacaatctgcctgacctcgttcttgatgcggtagtagttggcgtcgatctgctgctgcatggtgtcgttgccgtccttgtcggtgaagtcgatgatctgcggaatcttcacgtagcgggcggtctcccgcttgacctgctcgttatccacgacaatctcggcatggaaaatcttctgctcgatacgctcgtcgaaattgtcggctaccgccccgacgaacataccctgcgtgaggttggaaatcttgctcgccggaatgaggctgtccatctgggtattgatggagacggaggtctcgttccggttgatggtcatgttctgccgtttctgcaagaccttgccgaaacgttcacttaacgttttggcggtttcggcaactacctgacctgcaaatacattgccgacggtattgcagattacagcggactctttgtccccgtaatcacgctttagctggctgaaatcctgaaagccgagcatgacggctaccttgttgcttcgggcggtggcaatgagattgtccagcccacgcatatagatggtaggcagctcgtcgataatcacggcggatttgagccgtttcttcttgttgatgagcttcacgatgcgggagttgtacagtcccaacgccgccccgtagatgccctggcggtcggggttgttgccgactaccagcactttcggctcttcgggattgttgatgtcgagggtgaaatcatccgccgtcatcacccagtagagcgccggggagatcatgcgggaaagcggtatcttggcactggctatctgcccctgtaactgctccaccgctgaggattcccatgcgtccatgaagggagaaaggtagttctccagctccgggtacgaggtgaggatgggaaaaatgtcggcgtacttgcggttcaggaactcgatggcatgggggaaagtgcaatacttgccgttcttgtagattttgagataccatataatactggctaacagaatgataggcgattctacgaagaagtcgccctgtttggaaatccacgtgcggttcaaatttaacataatcgtgtaggcactctcgtaggcatcggatatgtcggtcatgaagtcggggtggatggggttgcagcggtggctctccctcggattatcgaagtttatcacgtagaacttgggcttgaccttgtagccgtccaagtgggcgagcaggtggttgtaagctatctcggagaggtcggggtacttgaaatcatacaggaaaagcgaatagcccttctcgatggtctggtcgggtaggtcagctccctttcgggagctttcccccctaagaaccgtacatgccctatcatcttcatatgccatcttattttttagagacatttactgaatatccctaagtaacagacaatatcggataaaatattgtacctttgtattggcttagacattgagcccaaatagaagtgaaatatcggaaacgaattgcaccgaaaaaaagaataaatcgctcgtattgacaccgtagatgagttaataataactaaaagggttaaatattcaccacttagaatatacccttaaaggctacgaccatatttccggcttaccaccagtaaactattgattaactctatcaccaaatagcggtgtaggaaggtattgtacatcaatatgtcaatatagtaatcatctcctgacacctcaatatggtattgtcgtcccatgaaagcaaaacctgcacccatttccacaaggaatttctctacatgtttcaccaaaccgatttctacatcacgctcattgtattggtcggtaaaggtcagcatatcgaatatatacgggtctttgagcattgatttcacatcgtttacttcgggaacaggcagggtttcagtgaaattgtttgccaacgcaccatgcttgccatagtcatcaagtttgatagcttcttgcagatagcgtgtattccaatgcgatgtaatactttgcaccatataccaataccgtgcgcgaatatccttgacttgttgtaagagtatcaggttatgcgtccagcctagatgtttgataggaaagaaaaaattatattcgcctaattgcgcaatcattgattgcgcaattgaagaatcagcacctttcaccatcgtaagttcttgattgtattcgttgaagaactgtatcatacactgcatgttgcgcacagaaaaaccctttatttcggaataatcgttcttcaagtccacggacaagcgttgcaaggttttcttgccccaaccatctgcatcttgactttgctgcaacatacctccaatatcccaatacattcggagcatttcttcgttggcggcataaatcgctcgttgttgggcaaccaatacccgctgcttgattttacgaagcagtgccgcataaccattgaaattatctgccaagttatcaattgcttgtttatctgtatttttagtcataatcttctttgacatttccacaaagttacgctttttattcgattgtacatcaaattcttacaatattattagttatacccattatggactattttctcattgagaaacctcttttctgctgttggtcataatgttatcttacaatcggtcttttcttttagcatttctataaattcgaccaagttattttcttttcccatgataagttgtcatccaataaacacaatgtttccatgacttcctagttcgatgcagtcatttcaaaatcaagagaataccgagcgaacggataagatacactgttttcaacctcaaattatacggaaaaacccataccttttttatacctttgcccccaaaagaaaacaacagacatggaactattcaataaaatgattgccgcagccctgaaggtttccgtacatcaagtagacaatacattatctctactgggcgggggagctaccatccctttcataagccgataccggaaagaggcaaccggaggactggacgaagtacaaataggcgaaattaaagacagaaatgacaagttgtgtgaactggccaagcgaaaagaaactattctttctaccatagaagaacagggcaaactgacagaagaattgcgcaaacgcattgaacagagttgggatgccaccgaagtggaagacatatatctgccctataagccgaaacgtaagacccgcgccgaagcggcacggcaaaaaggactggaaccgcttgccaccttactattattgcaacgcgaaaaccatctggacagccgtctccccgcttttgtgaaaggagatgtgaaagacgaagaggatgcgctgaaaggcgcgcgcgacatcatagccgaacaagtgagcgaggacgagcgcgcccgcaaccaactgcgcaaccaattttcccgacaagctgtcatcacctccaaagtggtgaaaggcaaagaggaagaagctgccaaataccgcgattatttcgatttcagcgaacctttgaaacgctgttcctcccaccgtctgctggctatccgccggggagagtcggaaggcctgttgaaagtaagtataagtcctgatgacgaagagtgcgccggacggctggaacaaatgtatgtccgtggcaacaatgaatgcagccgccaggtaggcgaggcagtgcgtgatgcgtacaagcggcttctgaagccttccatcgaaaccgaattttcagccttgagcaaggagaaagccgacgaggaggcaatccgcgtcttcgccggaaacctgagacagcttctgctggctcctcctttggggcagaaacgggtcatgggagttgatcccggctaccgtaccggatgtaaaatagtctgtctggacgcacaaggctctttgctgcacaatgaaaccatttatccgcatccgcccaagaatgaatactcacaggcagcccgcagcatcgtgaaattggtagaacaatatcagatagaggcaatcgccataggcaatggcaccgccagccgtgagacagaacaattcatcacttcacaacgctataaccgtgaattgcaagtatttgtagtaagcgaggacggagcatccatttactcggcctcgaaaaccgcccgagacgagttccctgaatacgacgtgaccgtgcgtggagccgtatccataggccgccggttgatggacccgctggccgaactggtgaaaatagatgccaaatctatcggggtgggacaataccagcatgatgtggaccagactttattgaagaaatcattggaccagacagtggaaagttgtgtgaacctggtaggtgtgaacctcaataccgccagccgccatctgctgacttatatatcggggctaggtcctgccttggctcaaaacattgtggattaccgcaccgagaacgggcctttcagttcacgcaaggagttattgaaagtaccccggatgggagcgaaagcgtttgagcaatgcgcagggttcctgcgtatcccacaagcgaagaatccgctggacaactcggccgtgcatcccgaaagctatcccatagtggagcagatagccaaagacctgaactgcaccgtagacgaactgataaaaagcaaagaactgcgcagccggattgatatcaagaagtatgtcaccccgacagtggggcttcccaccctgacagacatcatgcaggaattggacaagccgggacgcgacccacggcaacaaatccaagtttttgaatttgacaagaatgtaaagaccatagaggatttgactgaaggaatggaactgcccggcattgtgaacaatattaccaacttcggttgctttgtagatataggaatcaaagagaagggtctggtgcacgtatcacaactggccgacaaatttgtgagcgaccccaccaccgtagtcagcatccatcagcatgtacgggtgaaagtgatgagcatagacctagagcgcaagcgcatccagctcactatgaaaggattgaatcaataattgcaacaaggtaaaaaagaatatggaagaagatatagaaacctgcggctggttcgttttttataaggatcagctgctgatagagaaaaagaacggaatgtacaccatacctttcggaacagagcctcccatgcctgttccggtgggaagcactatccacaccatcggagagatagagggacgcactgccaagactttctccgtacatgccccggtgcccggcagcgaaaatgaccgccacctgatgatggatctccggagttcatacgacgtattgccttgggaagagtacaatgtgggtggaaaagccttccagatactgaattgggacaagaacagccgctattgccccatgtgcggcgtacctaccgtacagatttctcctattgctaaaaaatgcccccaatgtcgtcaggaaatttatccgcgcatctctcctgccatcattgtattgatacgccgggaagacagcatactgctggtccacgcccgcaacttccggggaaccttcaacggtttggtagccggttttcttgaaccgggcgaaactttggaggaatgtgtgcaccgcgaggtactggaagaaacaggactccatatcaaaaacctgaaatatttcggcagccagccgtggccttatcccagcggaatcatgataggcttcaccgccgattatgaaagcggaaacatcaaactacaacaagaagaactgaatgccggcgctttctataccaaagacaacttgccggagatacccaaaaagctgagcctggcaagaaaactgattgatgcgtggctggaggaaaaggatcatttatagaacgagatgagtcatgttccatccataaatacctatttatcgcttgcagaacttaaaaatgtactatctttgcaatatggaatggttaaatagcttattttttgaacacacgcctttacaggcggttgtaatcctctcgattatcattgccgtggggctcggtttaggtaaaatccacctgtttggcatttcattgggagttaccttcgtcttttttgccggtattctggccggacacctgggattctcaatcgacccgaatatgctgaattacgccgagagtttcggtcttgtgctttttgtatacgaactgggcttgcaggtaggtcccggctttttcagttcattccgtaaaggcggcgtacagctcaatatgctgggcataggcgttattctggcaggtacggtcatgacggtgcttttcagcaaactgggaggcataccgatgagcgatatggtaggcatcctttgtggagccaccaccaatactcccgctttgggggccgcccaacagacattgaaacaaatgggggaacccgccagtggcgctgcgttaagttgcgccgtaacctatccgctgggagtggtaggtgttattctggccatgctgctggtacgcaaattatttgtccgtccctcagatatcgacattcacgagcacgaggacaccaatcaaacgttcattgccaccttcaaagtgcacaatcccgccattttcaataaaagcataaaagaagtagctttattaagctatcctaaatttgttatctcccgtttatggcgggaaggtacggtaagcatccccacttccgaaaaaatactgaaagagaatgatcgcctgctggttatcaccaccgaaaaggacgctccctcgctcacgattcttttcggcgaacaggaaaaccaggattggaataaagaagacatcgactggaatgccatagacagccaattgatttccaaacatatcgttatcagccgccccgaaataaacgggaaaaaactaggctctttacgtctgcgcaacagctatggcatcaacatcagccgtgtgatgcgcagcggggtacaactgcttgccacaccggggctgatcctccaactgggcgaccggctgaccgtagtgggagaagccaaagccatagagaatgtggaaaaagtattgggcaatgcggttaaaacgttgaaggaccctaatcttgccgccatttttataggtattgtactgggattgatactaggctccatccctatcgccatccccggcatcagcactcccgttaaattaggcctggcaggcggacctatcgtagtaggaattcttatcggatgctttggcccccgtttccacctcatcacttataccacccggagtgccaacctgatgctgcgcggtatcgggttatccctctatctggcttgcctgggactggatgcaggcgcacatttcttcgagacagtgatgcgccccgaaggagccatctggatagctgtaggcttcgccatcacctttattccggtagtcattatggcattagtggccctccgcataagccacctcgacttcggaagcacctgtggcatgctgtgtggaagcatggcaaaccctatggcattgaactatgccaatgacacgttacccggtgataatccggcagtgagttatgccaccgtatatccgctgtccatgttcagccgggtcattatagcccaattaatacttatgttttttatataatttccagctatgaacgcttataattctatcacaccggaaaccatacaggaagatatgcgatacctgcaactgctgtcgcatagtttccccactatagccgatgccagtacggaaataatcaacctggaagctattctgaacctgcctaaaggtacagaacatttccttgccgacctgcacggagagtacgaggcattccagcatgtattgcggaatgcttccggggccatcaaaagaaaagtaaatgaaatattcggcaataccctgcgcgagaatgaaaaaaaagaactatgtacgctgatttattatccggaacaaaaactggatctggtaaaagcagtggaaacggatttggacgactggtatgtcatcacgttgaaccaactggtacgtgtatgccagaatgtatcctccaaatatacccgttccaaagtgcggaagtcgcttcccaaagaattctcgtatatcattcaggagttgttgcacgaaaactcaatggttcccaacaaacaggcgtatattaatgtcatcatcagcaccatcatttctacccgccgcgccgatgactttatcattgccctatgcaacctcatccaacggctcaccatagacacactgcatgtgctgggtgatatattcgaccgtggccctgccccccaccgcattatggacatattatgcgattatcataatttcgacgtacaatggggaaaccatgacattttatggatgggagccgcagccggcaacgactgctgtatggcaaacgtgctacgcctggccatgcgttatggcaaccttgccgctctggaggacggatatggcatcaaccttctgcccctggccacctttgccatggaaacatacgctgatgatccctgcaccctgttcggaccgaaagtagagaaagaagactgtacgtacaatgccaagacgctgcgcatgataggccagatgcacaaagcaatcagtgttatccagttcaagctggaagcggagattatcaggcgccgccccgatttcgagatggacgaccgtatgctgctacaccgtatagacttcgagcgtaagaccatcacaatgcccaatggaaaagaatatgagctgaaagacagttttcttcctacggtagatcctgccgatccttataagctgacagacgaagaacgggaaattatgaacaaactccatcgttcatttgtcagcagtgagaaattgaaaaaacatatccgctgcctgttccgttacggatgcatgtacacggtgagcaactcaaatctgctgttccacgcctccattcccttgaatgccgacggtacgctgaaagatgtgtccatagccggaaaaacgtacaagggaaaagccttgctggaaaaagtagggcatttgatccgtaccgccttcttcgctgaggaagacaacgaggacagaccctttgctgtagactatgtatggtacttgtggtgtggcaaagactcccctgctttcgacaaagacaaaatggctacttttgaacgttacttcttaaaagagaaagagttgcacaaggaagtgaaaggtcactattacagcctgcgcaatgaagaaaaagtatgtgacatgctgctggacgagttcggcgtgataggaacacaccgccatatcatcaacgggcatgtacccgtaaaaaccatccaaggtgagaatccgataaaagcaaacggcaagatgatggtcatagacggaggattctctaaagcgtatcattcggaaaccggaattgccggatatacactggtataccattcgcgcggattccaactggtacagcacgaaccgttcacctcaatgcaaaaagccattgaagaagggcaggatatcaaatcgagcactcagatagtagaaatgagcacccaacgcatgatggtaaaggacactgacaaaggacgggaactggtgacacagatcaacgatttaaagaaattgctgatggcctaccggacaggacttatcaaggagaaatccatataaacagattatccgcaatcatactaccggataataaatgaaagtttattgccctatgattgcggataaaaaaataaagcccgtatcagactcacgtctaccgggcttttggattaccgaacaaaaatatcgttatacaatcttgttcatcgccgaatcggggaaaaccaccgtcggcttgaacgatttagcttcctcaaaatccatcatggcgtatgacatgataatcacaatgtcacccacctgtactttccgggcagcagccccattcagacaaatacatcccgaaccgcgctcacccttaataatataagtttcaaacctctcgccgttattattatccacaatgtgcactttctcgccggcaatcatgttggcggcatccatcaagtcctcgtcaatcgtaatactacccatgtaattcaaattggcttccgttacacggacacaatgcagtttcgactttaatacctcaatcatcataattctaatggttaacgatcactatcccttatattttatattatctatcaaacgtacctctccgcaaaataccgtaatgcaacctactgcataatccgtatcttcccaatccgttattttctgaagcgtagtgccgtctactatttcaaaatattccagacgcaaacccggagcggcagcaatcgcatcttctacaaacttctgagtctcagcgaccggatgagattttgcaaaagtacaactcttaaataaagtctgcgaaatattcagcgcatactctctctccaccgcagaaagccgtgcattgcggctgctcaatgccagcccgtcttcctcacgcacaataggacaacctacaatttccagtccgttgaaccctatctgtttcaccatttcacgaataatagccaactgctggaaatctttctcgccgaaataagcacgggtaggatttacaatcataaacagcttgctcactatctggcatactccattgaaatgtcccggacggaaacggccttccatcactgtgtccaacggcgcatagctgaactgccgggtatcaggctcaggataaatctcttctacagacggagcaaaaacaaaagccgcccctactttttccaacaattcacaatcggcatccaatgtacgcggatattttgccaagtcatttttgtcgttaaactgggtaggattcacaaaatcacttaccaccactacatcattttctgcaacagcacgtttcaccaacgaagcgtgtccggcatggagtgcacccatcgtaggtaccagacctattgtctttccctcactacgcagggcatccagctctgactgaagctctttgattgtttgaactaacttcatctttttatctcttttgtttgagtagtttcatttaaaacggctgcaaagtaaaccattatttgggagataacgaagaaaaaaaagaattttaattaatgatgagtaattagtaataagcggttaataccttgcagatatggcgcaataagccctcttcagccaccggcgggccacttgttctttcccgtttttcacctaattccgcaagacatcggccattaacttcaaattgctaacgactaattaccagccacttaacatatcataaggaattattattcctcgtttcttgccactctcatctattttttttatatctttgcaaaatgattatgagcaacaaaaagttaagatgaaggcaaataaagttttatttattacacaagagattaccccttacgttcccgaatccgaaatggcaaacatgggaagatttcttcctcaggctattcaggaaaaaggcagagaaatcagaacttttatgccaaaatggggcaatgtcaatgaacgcagaaaccaattacacgaagtcatccgcctgtccggcatgaatttaatcatagacgatacggaccatccgctgattatcaaggtagcatctatccaagctgcacgtatgcaggtttacttcattgacaatgacgactatttccagcaccgccaaatggtagctgacgaaaacggtgtagaatacaaagacaatgacgaacgtgctattttttatgcacgcggcgtattggaaacggtaaagaaattacgctggtgtccggacattatccattgccaagggtggatgagtgcatttgtacctctttatatcaagaaggcttatcaggatgaaccgtcattcagagactcaaaagtagtattttcggtatttgaagatgatttcaaatcggactgcgaaggtaatctgactgaaaaactcatgctgaaaggcattgaaaagaatgatgtggaaagcatcgtcaaatctccggcaaattacgaggagctgtgcaaactggccattgcctactccgacggtgtgatacaaaacagcgaaaaagtgaacgagaatgtcatgaaattcgcccgtgaatcgggtgtgcccgtgctcgactatcagcctgccgatacctatgtagatgctttcaatgagttctatgacaaagtatgggagtttgaaaagaaataactcactaagaataataaagatgaaaatcaaatacttatgcgcattgttgttggctgcacttatttatagttgcgatgattcaacaaccggcatcgggactgatcttatccccggtggagataagattccggcaaatacagacagttatgagtttaccaccaaatctctgttggccgactccgtttatgcacgtaccagtactgcatatttaggacgatataccgatgagcaatttggagaatttactgccgactttatagcacagttcacctgtatggacaacttcaaatttgaagaagagctgaccaaagtcatcggagtaaatataagtctgcaatacgggtctttctttggtgactcactgaatgccatgcgcttacaggttgacacattggacaaggttattcctgaaaaagaactaagtactttctataccagtgtggatcctaaagattattacaacgaaaaaggaaagcctatcgctgtaaaagcctattcggcagtaggtccgtctacaagcaaagatgaaactacaaccacaagcagcggtgtcaagcaaagaacaattatacagactatcaaattgcccaattcattaggcgatcacatcttcaacaaatacaaggagaacaaagagtatttcaagactcctgaaagttttatcaagaatgtattaaagggagtttacattcgctgtactcatggcgacggaaccattttatacattgacggtttaagcctgaatcttaattttgaagccctgatagaaagttcttccggcaagcgggattcgttggtttacaaatcctatttctttggagcaaccaaggaagtgatacaagccaaccacttcagtaacggtaacagattggaagagttagcccaagatccggaccatacttacctcaaaagtccggcaggtatttttacagaagcgactttccccattgcagagatttacaatgaacataaaagagatacgctaaatggtgtaaatgtatcattcacacgctacaacgagaaagagtccaaatacaaaatgggcatcccccaatatgtattgatggtcagaaagaaagatatgttctcgttctttgaagaaaacaagattatcgataacaagacttctttcttaagttcatatagcagcagtaacaatacatacacctttaccaacatcgctcccttaatcacttactgcattgaggaacggaaaaaaggcataacagcagcaggtggagatcctgaaaaggaagaagacggaaaagaatgggacgctaaaaatccggactggaacagagttgtcatcatacctgtcaaagcagtatccaattcaaacaatgaaatagttgaaatatccaacagcttaggtatggaaagcgctatgttaaaaggtggaacgaatcctgagaataagctgaaaatgcaaatcttctacactacattttaagacttttttatttaaccaaataaagaacaggcggcaactacagcaatatagtttccgcctgtttaatttactccaccgtaatcataccacaccggatgataaatggaaattcatggaacgcaaatatcccatcaacacttcacaccatgattgagaatgaccataaaaacagactatataaaataagccggcaaaatccttttcacggatcctgccggcttatttatgtttatgggaatcctctatcccctagaaaggcaaatcatccttctcgtctgtcgcggcaaaatctaccggtgcagcgggagcagcattcatgggaggaaacggagcatccggtgcaacaggtccctgggcacccacacgctctactttccacgcacggatactgttgaaccaacgaccattccactcgcgggcatccacatcaaaaaacacattcaactcttcacctgcctgaatattaaattgcgctatcttatctgctccaaatacgtcaaaacacatttttttaggatattgatcatgcgtttcaattacgtattcttgtactttccattcatttcctgtctttgaaactcctcctctcggttcgaggactgctattacttttcctgctaattccatattacgttatttaaattcgccacgaaagtacacttttccttgcgagtaaactaattttttcgccattttttgcgcttgaaccataatcttttcgtaactttggcagttaaatgaatatagagatatagaatataaatataataatataaaactatgaagttcatcgtttcaagtactggattattcagtcatttacaagctattagccgagtaatcaactccaaaaattcgttacctattcttgattgtttcttaatggaactgactgacggaacgttgtcgctcactgcctctgacagcgaaacgaccctgtccacttctttggaagtaaatgaaagtgacggtgacggacgctttgccgtttcttcaaaaaccatactcgaagccctgaaagaaatacccgaacaaccactgactttcctggtaaatacagagaatctggaaatcaccgtacaatatcagaatggtaaatacagcctgatgggacaaaatgccgacgaatatccgcaggctcccgcattaggcgcaaatgcggtacacgtaacaatgggcgctccggtgatgctggcaggtatcaaccgttctttgttcgctactgccgatgacgagttacgtccggtaatgaatggtatttattttgatatcactaccgaagacatcactttcgtagcctcagacgggcacaaattagtacgcaataaaacatttgtggcacacggcgatgaaaaagccgctttcattctgcccaagaaaccggcaaccctgctgaagaacctgttgccgaaagaacaaggagatgtgcaaattgattttgacgaccgtaacgctacgtttacattagaaaactacagcatgatatgccgtcttatcgaaggacgctatcccaattataattcagtaattccgcaggataatccgcacaaggccaccattgaccgcatgatgctgatcagtgcgctccgccgtgtatctgtattctcatcacaagcaagcagtttgataaaactccgcctcagtgaaaatcagatccagatctccgcacaagacatagatttctccacctcagcagaagaaacactgacttgccaatatacaggaagccccatgagcatcggctttaaatcaacattcctgatcgatattttaaacaatatctcggcacaggaaatacttttcgaactggctgatccttcacgtgcgggtgttattgttcctgtagaacaggaagaaaaagaagacctgctgatgctgctgatgcctatgatgctgaacgactaaaaacgacacgccaccatgtggcggaaaaacaatatataatacaagctgaaaatgaaattgaacttgaagaatcctattgtttttttcgatttggaaacaacgggaacaaatataaacacagacagaatagtggaaatatgctatctgaaggtgtacccaaacggcaacgaagaaacgaagaccatgcgtatcaatccggaaatgcatattcccgaacaatcttctgccatccacggtatttatgacgcagatgtggcggactgccctactttcaaggaagtggcaaaagagatagcccgggacattgagggatgtgaccttgccggtttcaattccaatcgtttcgacattccggttttggccgaggagttcctgcgcgcaggagtagacattgacatgatgaaacgaaaattcattgacgtgcaggtgatttatcacaaactggaacagcgcaccctgtctgccgcctataaattctattgcggaaagaatctggaagatgcccatacagccgaagccgacacacgtgccacatacgaagtactgaaatcccaattggaccgctatccggaagaattgcaaaacgatatggcatttctagccgaatattcaagtttcaacaagaacgtagatttcgccggacgcattgtttatgatgacaaaggcgtggaagtctttaattttgggaaatacaaaggaatgtcggtcagcgaagtattacaaaaagatccgggctactacagctggatactgaacggtgactttacgctgaacacgaaaaacgtactgacaaaaatcagactacgtgaatcgggaatgatgaaatgagtatgaaaggaaaaaaaatcgtactaggtataaccggaagtatagccgcctataaagcggctatactcattcgcggacttattaagaagggagcggaagtacaagtcgtgattacccccgcaggcaaagaattcatcacacctatcactttgtctgcattaacaagcaaacctgttatcagcgagttttttgcccagcgtgacgggacatggaacagccacgttgatttgggactatgggcggatgccatgattatcgctccggctaccgcatccactattggtaaaatggccaacggaatagcggacaatatgctgatcacgacttatctgtcaatgaaagctcccgtattcgtagctccggcaatggatctggatatgttcgcacacccttccacccggaagaatctggacacgctccgttcttacggaaatcatattatagaaccggcagaaggggaactggcaagccatctggtaggaaaaggcagaatggaagaaccggaaaaaatagtggaaattctggaagctttctttgccaaacaacaagacatggccggaaagaaagtagtcattaccgccggtccaacctacgagaaaatagatccggtacgctttatcggcaattattcttcaggaaaaatgggattcgcacttgccgaggaatgcgcttcacgtggagcggaagtatcgctaatcagcggaccggtaacgattcaggcccatcaccctaacatccgccgcatagatgtggaaagtgccggagaaatgtacgaagccgccatccgcgagtttcctacagcttcggccggcatcctgtgtgcggcagtggccgactttaccccggaaaccgtagccggtcataaaatcaaaagagagaaagataatttaacactgcaactgaaacccacacaagacattgccgccgcactgggaaaccggaaaaaagacggacagacattagtgggatttgccttggaaacaaatgatgaaacaaaaaatgcacaaagaaaactggaacgtaagaaccttgatttcattgtactgaactcattgaacgaccaaggagccgggtttcgttgtgacaccaacaaaataacgattatagaccgtcagggagcaactccttatccgctgaaaagcaaacaggaagtagcaagggatattattgacagactggtaaataataaataatttcttaatttgccacgttgccaatgtgctaatgcgctaattaccatgcggaatacaacagcgcagcaaattagcaaattgacaaatcagcaaattattaaaaaggagcaagaatatgctgcaatctatctatatacagaattatgcattgattgatacattggatatcagtttcacccccggcttctctgtcatcaccggagagaccggcgccggtaaatcgattattctaggcgctatcggcttgttactgggacaacgggccgatatcaaagcgatcaagaaaggcgccaataaatgtattgtagaagcacgtttcaacatctccgcctatcagatggagcctttctttacccaaagagatttggaatatgatccggatgaatgtattatccgccgcgagttatatgcatcaggtaaaagccgcgcattcataaacgatactccggcctcattggcgcagatgaaggaactgggcgagaaactgatagatgtacatagccagcatcaaaacctgttgctcaacagtgagggattccaattgaatgtattggatatcctggcacaagatgacaacgaactttcagcatacaaggatatttataccgagtacagaaacgtatgcaaacagctggccgacttcataacgcaagccgagcaaagccggaaggatgaagattacatccggttccaactggaacagctggatgatgcaaaccttcaggaaggagaacaaaccgaactggaacaggaagccgaaaccttgaatcatgccgaagagataaaagcgggtttgtacaaagtggaccaaataatggcttcggaagatgccagcctgttatccgctaccaaagaatgtatgcaaaccctgcataacatagcgagagtgtacacacgtgcccaggaatggatagggcgtttagacagttgttacatagaactgaaagatctgtcgcatgaaatagcaggcgcacaggaggaagtggagttcaaccccacccgtctggattatgtaaatgaacgcctgaacttaatctactctttgcaacagaagcatcacgtacaaacaatagaggaattgatagccgtgcaaaccgactatcatgagaagctgaacgccatcacttcttttgatgaccgtatagcagaacttaccgcccaaaaagaaacgctatatgacaaagtgataaagcaagctgctgtgttgacaaaactccgttcccaatcgggcaagcacattgaaagacagatgcaaagcctgctggttcctctcggtatgcccaatgtgcgctttgtggtggaactgaatccgcgcaaggaaccggacagtaaagggatggacagtgtgacattcctgttttcggccaacaagaatggaacattacaaaatgtagcttccgtagcatcgggtggtgagattgcccgtgtcatgctttcgctgaaagccatgatagccggagctgtgaaactgcctactatcatctttgatgaaatagacaccggagtttccggttccatcgccgagaaaatggcgctcatcatgcaggagatgggaaaacaaaaccgtcaggtcatcagcatcacccacctgccccagattgcagcacgcggcatcactcattataaagtatataaggaagatacggaaacaggcaccaacagccacatccgccgcctgactgatgaagaaagagtaaaagaaattgccaatatgctaagtggggctaccttgacagaggcagccctgaacaatgcaaaggcgctgataagtggctagtgccaattaccactaaccacctgtcactaaccattaaccacttattaaatatgttagaaaagaatgaaatgattttcggtgtacgcgctgttattgaagccatacaagccggaagagagatagataaagtattggtgaagaaagatatacagagcgaactgtccaaagaactgtttacctgcttgaaaaataccctcatccctgttcagcgtgtacccgtggagcgtattaaccgtattacccggaaaaaccatcagggagttgtagcattcatctcctctgtcacctaccagaaaacagaagatctggtacctttcctgtttgaagaaggaaaaacacccctattcgtcatgctggatggaattaccgatgtacgtaacttcggagccattgcccgtacctgcgaatgtgccggtgcagatgccattattattccctcgaaaaacagtgtcagtgtcaatgccgacgcaatgaaaacatcagcaggagctctgcacactcttcccgtatgccgcgaacaaaatctgactaataccatcaagtatctgaaagactgcggattcaagattgtagcagccacggaaaaaggtgattatgattacaccaaagcaaactataaagatcctgtatgtatcattatgggagccgaggacacaggtgttccctacgaacacctttccctgtgcgatgaatggatcaaaataccgttaatgggtaaaatagaatcattgaacgtatcggttgccgcaggtattctgatttatgaagctgtaaagcaacgcggcttcacagaagacaaaacggcatccgctttataaataccgtatcatcgttaacaaacaactaactatatcatgaagaaagtacttttgatactggcatgcggcatagccgcccagctaagctatgcacaagcaaccccaaagtgggccggcaaagctaaaaaagccgttttttccatcgttacatacgataaagataacaaaatcaagaatacaggaaatggattctatatcaatgaaaatggaacggcattatccgattataccttgtttgaaggagccgaacgtgcagtaatcattaatgcggacagtaaagaattgcctgtattgcgtatcttgggagccaactccatgtatgacatcgtaaaatttaatactgaaaccgataaaaagaccatagcattaaaatcggcatcacagccggcatcggtaggtgaaacagtctatctgctaccctactcgactcaaaaagcggcaacctgccagacagggaccgtcaccaaagtagacaccatcggcgacaaggcatattactatacactggcaatgacaaccaacgaaaaaacagtaagttgccctattatgaatgccaatggagaagtattaggtttaatccaaaaaaacgcatcggatgaagccaaggaaagttatgccatcggagctacatacggtgcctcgctgagcatcaccgccctttctttgaacgatatgtcactgaataaaatcggcatcaaaaaaggactgcccgaaacagaagaccaagcactggtgtacctgttcatggcatcttcacaacaaaatcaggacgaatatatcaccacattaaacgatttcctggaacaatatcccaacagcgcggacggatatatacgccgtgccactacttatatgggatttaatgatgatgaacacaacgctttggcagatgccgacctgaagaaagcactggaagtgacagccaacaagagtgaaacgcaatataatatcgctaaattaatttattcgtacaccatctctttaggtgacaagaaaccatacggtgactggagttacgacaaagctctctccattattcatgatgccatgcaggccgacaaccaacccatttacacacaattggagggagacattctgtttgctatgaaaaaatatcctgaggcatacgccgcttatgaaaaagtgaaccagtcttccatagcctctgccgctacattttactcggcagccaaaaccaaacaactgattgaaggaacagatatgaacgaggttattgccttgatggatagtgctgtggcacgtttcaccaagccttatacatcggaagcggctccttatttctatgaacgggcagagataaaagcccagacaggcaaataccgtgaagcggtaatagattatgatactttttatgatgccatcggtggacgcgttacagccgccttttatctgcaacgcgaacaggcggaaatacaatgtaaaatgtatcagcaagctatcaacgacattaataaagcagtagaaatgactcctgaggatgtagccatgtgggtggaaaaaggttcggtgcatctacgtgtagggcaacataacgaagcaatagaagcattggaaaaggctatctctttagacccgaaagccgcagccgcatatcgtatgctgggatactgccagatacaattaaagaaaaacaaagaagcctgtgcaaattttgccaaagcaaaagaactgggcgatgaagtggtagacggactgatacagaagtattgcaaataataccgggaagctccatctgaaatccgcgaatcttgctacatgatttctgaaatcttgttgcatgattcgcggatttttgctacaagatttcaggaaacattccctgtcattcatgaaaaagcaggaaagaaaaaaaatctacttatcttcccactgccgtataatcagtacccgtttcgtatcttccgtcacccggaaacggtcatcgctacgctctcctaccagccatacaatccggtctgctgagcaaaccacatactgattttctttctggaaaagagaaaacttacgatctgtcagataatcgctgaccttcttttttcctttcattccgaaaggaacaaacttatccccctgccgccatttacgcaccgtgagaggtagtaccaccttgtccgcatccaaacaggccgtattcttattcctggggatgacaaagtccggcattatttcctgcgtttccattgcaagccggaatgggggcacattttcctccacttcctcatccgccggcttcctcctgcgaataatcagctccgtcctgtcgcgcaacacctcccatccggcagaaacgaatctttttcccgactgggcagacaaactgcggaatacatctcctatctgaacggaattgaaacctaacggatgaagaatctcaaacagcaaagccgccggagcactctcttccatcaaacgagaaataagaatatggccggacttttccatcaccctttctttccccgcctctatttccttattatatataagagaaacatcagtcagacgtctggatgtttcagctatactttcactgacagaaggattcagctcacgcaacatcggaagaatattcagacggattttattacgcatatattcatcttgcagattggtactgtctgtaacataaccttgacgcaaacaacgcaaataatccaaaatatcctgacggctcacctccaacaaaggccgtacaatgcagccgttatgcggactgatacctttcaagccattgattcccgcgccacgtatcaaattcaataaaaaagtttccacactatcgtcccgatgatgggctacggcaataacagccatccccctctccttacgcagttgttcgaaccaatcatagcgcatttcgcgagctgccatctcaacagaaacatgatgccttgaagcataagtgactgtatcaaaatgagtaacatgcaaagtcactcccagccctttacacaactcattgacaaacctttcatctctatcggactcctcaccacgaagatggaagttacaatgggcagcctcacaatgataccctaaaacaagcaagacacgcaacaaagctaccgaatctgctccgccactcaatgccactaacaccttatcatgcaaagtgaaaagttgtttttcctctatatacttctgaatattccaatgaaacatgacacaaagataagggttctgcaagacaaaaacaaagtgcctgttctttatttaaaaacaatctaaatagtttgcatacttctaagtaataacttatctttgcgaaaaatttaaaacaagatgcgtttatccgaattaagaacaggagaaaaaggcgtaatagtcaaggttttaggtcacggtggtttccgcaagcgaatcgttgaaatgggttttattaaaggaaaaaccgtagaggtaatcttgaacgcccctttgaaagaccctataaaatacagactactaggttacgagatctctctccgaagacaagaggcagatatgattgaggtggtaagcgagcaggaagcacgcacgatgcaaaacccttaccatggttccataacagaagatgtacccgtgtccgaatcagaactggtggcactggcaaaaggcaaacgccgtacaatcaatgtagccttagtaggtaatcctaattgtggaaagacttcgctattcaatattgcatccggcgcccatgaacatgtaggaaactacagtggtgtgacagtagatgccaaagaaggttttttcgacttccaaggttatcatttccgtattgtagatttacccggaacctattctctttcagcctatactccggaagaactttatgtacgcaaacatatcattgaagaaactccggatgtaatcatcaatgtggcagactcttccaacctggaacgtaatttctatcttaccacccaattgattgacatgaatgtgcgtatggtcatcgcactgaatatgtatgacgaactggaaagcagcggcaacaaactggattacatcaagttaagccaattgatcggagtgcctatgatacctactgtctgccggcggggtgaaggcatagaccaactgtttcatgttatcatcggtatttacgaaggcggggatttcctgtcacaaaagggcgaaatacgttctgaaattctggaagatctgagagactggcacaaaacctatgtacccgaccacgaattcggaagtcacaaagaagaggaagatgcccgcccacgcggatatatgcgccatattcacattaaccacggtcctgaactggagcgcagtatcgaagaagtaaaaaaagcaatcagtcaaaacgaagacatacgccataaatactccacccgcttcctatctatcaaattactggaaaacgataaggaaatagaaaatttcatctctacactgcctaatggcaaagaaatcatagcgatacgcaacaaggaaaccttacgtatccgtaaagtgatgaacgaagacagcgagcaagctattacggatgctaaatatggttttattaccggagctttgaaggaaacattcaccgacaatcatttggaaaaagaacaaacaacccgcgtgatagacagtattgtgacacatcgcatttggggatatcctatttttttcctgttcctttacatcatgtttgagggaacctttgttttgggtgactaccctatgcaaggtattgaatggctagtagaccagttgggcaacctgatacggaacaatatggctgaaggtcctttgaaagacttactgatagatggtattatcggtggagtgggcggtgttatcgttttcctgccgaatatcctcatattatacttttttatttctatattggaagattcggggtatatggcacgcgctgcatttatcatggataaaataatgcaccggatgggactgcatggcaagtcctttattccactgattatgggattcggctgtaatgtacctgccataatggcaacacgtactatagaagaccgaaagtccagactaatcaccatgttggtgaatcctttaatgtcctgtagtgctcgtcttcccatatatttagttatgataggtgcttttttccctaactgcgccagctttatgctactttgcatctacacagcaggcattttattggcagtaataatggcccgtattttcagtaaatttctggtgaaaggagaagattctccatttgtgatggaactccccccctatcgtatgcctacctctaaaagtatcatgcgccatacatgggaaaaaggagcacaatatctgaaaaagatgggaggcattatcatgattgcctcaattattatctggtttctagggtattatccacaacatgatgcttacgaaaacgtggctgagcaacaagaaaattcatatatcggacaaataggcaaagccatagagcctgttatcaaaccgctaggatttgactggaagttaggaatcggacttatttcaggtgtgggtgctaaagaactggtagtaagcacactaggagtattatacacaaatgaaggagatgtggaaaatgtgaatctttctaaccgcatccccattactccactggttgcattagcttacatgctgtttgtattgatttacttcccctgtattgccactttcgcagcaatcaagcaagaatccggcagttggaaatgggccatattcacagcaggatacaccactggattggcttggcttgttgcatttactgtatttcaaataggaagtcttatcgtttaataaacctaaaattatttgtttatcaagcatggagttacaacaaattatagttattgcaattgtatgcctctgcaccatatggataagcatacgtatctttcagtatttcaagcgcataaagaacaatagcaatccgtgtgaatgctgtagttcggactgcgccatgaagtctatgcagaacaagccaaagtacggttgcgaaaaaaatgcagaaaaagtgagaaaaaaatagcagaatatttgcagattaaaaaaaatgtcgtacctttgcaaccgcaatcgagaaacaaagattgctaacgacaaggttccttggatgagtggcttagtcagcggtctgcaaaaccgtgtacggcggttcgaatccgccaggaacctccaaaagcgaaaatggattagaatgaaaatttctaatccattttcgcttttcagctacttacgtcctctatggtagaagtagagaagggtgggctttccacccccgcgactccactggagatgttgaggctttatagctccctctataaattatattacagacatccatctgcatgcgaaatcaaacaacaaaccgttttcaccccgtatgacgaatgtgaatattttatggacgggtgcgatataatgttagatcaactttattcttatcccctgggattaaaatgcattatatgccatgagcaaaggaattatagttgtagaaggtgcagaagaggaacattacaacttattaggcaaagacagacttcatcctatcatcaacgtataccctgaagaaaatgacatttataataaactagatagtttattagctaacccaaatttctcaattatccgccgacagcattgaatatatcaaaaaataccattgcccaataaggtggctaaagaatgtttggatttttgggagaaaaattaattccatccattagcacttcactatcagcatcttattacttccatcaaaaaaaatatatctaaaaaaagagcaaaatgtttgcataattcaatttatccccttatctttgcaccgcgtttgagagataacgcttctgaaaagaaggaagtttgggtgagtggctgaaaccaccagtttgctaaactgacgtacgggtaaccgtaccgggggttcgaatcccccagcttccgcaagcgggtcataaaagtagtttatgacccgcttttatttttcaacgatttgagatcaaggctttcggaagccctaaaaagacggctcaaaatacttcattaaaacttcagggaagataaccagtagtaacttatgtagattgcgatcagaatcgcattgggttgtttttttaatccaaccgcactgatagcttactttcgcgtattaacataacatacccacagttttttcggactgaccattaaattcctattttatagtaacagcacaaaaaaaatcattttttattttgcagattaaaaacaaacttttaactttgcagcgtcttagaaaaagagttaagagcaactgatggcggtatcgtctagtggcctaggacgcggccctctcacggctgaaactcgggttcgattcccggttccgctacctttagaagctaattggtttattgtcaccaattagctttatttttttataaaactaaaataaaaagagtacttatcattttttcatttattgactactttatacttaaaaatgcacaagtattcgcattataccgggtcaacgtaacaatctgagggattttatatttaagcatataatttagcaagtcattcagtaactttatagccaactccttgtcggctatcgcggcatactgcttttttgaaaagaagcccgccattgacgtaaagtttgtcaatgacggacaacttgctattttttgattttatttcgaactcacgttgatatatttttaatgtttttttatttatcctttctttccatgcgacatcaaaaagcctgtatgaaaaattattgtcaatacatagtatcaattccaacagagtacttttctctgagccgttcgctccaacgatacaattgacttgttatctgcatggaaaccgcaaaagtatcatccccaaaacaagaacagtacatctgatttaggaattttctccttcatcttgctcgttgtccattcatttccatatgttctgttcggatggctccatgggacttgccgaaaggatactgtgtccttcatgtaatttctttattacagaacttcttcctgcttttaattttattccaataatcttcataaattcgaataaatacttggttacttcaagcacactctgaaatatatcccaacagacaaaaaccgactgtcatacagtgctgccaccacattgatccggtctttccacaccgaatagtttgttcccacgttccacacgccatcataatattctcccatcagatttagtccgttcaacgctttattccaaaaatcatcttcagtacggttgaaacggtaatttatgcctaccgtcatgccgtgttcattgtcaaaatccaaaccgtcaaactggatgactgaagcgtgtaaacccaatgttccccatttctcaaaagtaaaatgcttggtagcagctacatagaaacgggtcagatgattggtgctttctcctacatcttgaaatgtaaggtcaccgccgcctgcactctcgtgactacccggatcattcgctcccagcacgatttgtggtgtccattgctgccaccaaccttctttccacagacgcaaacgcccatgaaacgaacggtcttgattggtaaatttgccccaagtctgctgcggccagtaattgctgccatgaatgccttttaccagcgtacaggtataagctatttccaaccatggaaacagcgtaatgttcagatagtagttataagtataaggattatactcatcatgggcattccaataggcatcacgataaatattgtggtctatcatgctgccaccaatcatgacagtcttgtctttctgcatttcggctgtaggagaataaagcagccctgatgtgccgtaggtatgctgacccaacatattggtcaccaaacagcacaatataataaacgaataaaaatatttcatggaaagtcttcagatttttgatctttttcatgcattattgacttttcagaattgcgtttttacaaattaaaacagattcaatactttttctacgatgtggtgcatgtcataatacttatactccgcaagccttccaccgaagataacgttcgtttccttatccgctagctctttgtatttcagataaagcgcattgttcttttcgttattcaccggataataaggctcgctgccttccgtccattccgaactgtattcacgtgatatgaccgtcttagggcaattgtccacatccgtgccgaacatctcaaaatgcttgtgctcgatgacccgtgtgtaaggcacttcccgttccgtatagttcaccaccgcattgccctggtagttcggagtatccaatgtttccatctcaaaccgcaccgtgcggtattccagtttgccgaaccgataaccgtaatattcatcaatggctccggtaaacaccaccttatccgccagagcttccaattcttcacgatgagcaaaaaaatcacagcccaaccgtgtatctgctccgtccagcagacgctctatcaacacattatatccgccgatgggaatcccctggtatttgtcattaaaatagttattgtcgaaaactagacgcacgggcaacctcttgatgatgaaagccggaagctctgtacatttccgtccccattgcttctcggtataaccttttatcagtttctcgtaaatgtccttgccgataagcatctgcgcctgctcttctaaattgcgtggttcggttacaccgtccaccttcatacgggctatagctttcgccttctgttcctctatcttagccgtggcttcggctggggttgtcacgccccacatctgatagaacgtattcatgttgaaaggcaagttgtatagattacctttgtaatttgccacgggcgaattggtataacggttgaactccacaatcgagttgacgaaatcccacaccttcttattcgaggtatgaaagatgtgtgcaccgtatttatgcacattgataccttccatcttttcgcaatagatgtttccacccaaatgaggacgacggtcgatgactaagcatttcttgccctgttgtttagtcttgtaggcaaatacggagccgaaaagccctgcacctactatcaggtaatcataatgtttcatagttgacaaaatcataaatgatcaaaaaacatagcgattcaaatatcctatagatttataatcctctatttttaaaatatttatcatacccttccagcaaagccttgctcgtatgctcccacgaaagttcgttcactacacggtttctgccaaacttgcccattcgcttccgttcttccggatgatccagcaggtacactatcttttccgccatatccttagcatcgttatgcttggcatagagcgagccctcctgtgcgctatacctcccttccgttaagtcgaattgcacgatgggcttgcccaatgccatgtattccaatatcttgttcattgtgcttttgtcattcattgcattatattcatccgaattgacgcatacgtccgccgtattcaggtagtccagcaactgtgcatcgggcacacgccccgtaaattccacgatgtcatccagttccatcttcgtagcctgctttctcaactggtctaagtggggacctccacccacaataccccaaaatatatcatccctctttaggtcttccttgatataccgggcggcttccagcagatattctattccctcttgttgccctattacgcccaaataacctaccatgtactttcgtcctcgctttatctcaggtttagccggcactatccgcagccgttccagcttaggaccgctacgcagtactatcacgtcttctggcttcatgccccccctctcaatggctatcttccgataactctcgttagtcacaaaggcaaatttgctgtgcctgtaagtctgccgttccaaccacagctggcttttgtagagcaaccctttggtatgtccgaatttagcctcaaacagttcagggcaaatatcgtgatggtcgaatatgtactccactcctttccccttgaacattcgtgccaccatccaaatgtcatcaggcggattacagccatgaatgcagtggaagccatgttccttccacacccgcttggccaaagtatattcagcccaaagggcactaaaatattcgcggacatagcctaccgcaccgttcccttccttgggaagcttatggcggtagatatgcacaccttgcaagtattcatactccttgtcaaagcctttgcctgtggggcaaatgactgaaaccgtatatccgttggtagccaacgttgtcgcctcctgccacacacgggtgtcaaaaggcacagggaggttttctacgataattagaattcttctatccattatgtatgtgctatgaattaatgataaaggttgattttgaaattgacagaaagcctcatgccgctgccataaatccgtatggccgtagtccgtgctttcgtgccataggattcgcttatccatgcctcttccagacaaattttctccacggaagtccctatggtcatgatgacctcattctgtccgcagcctatccggaagccgttttccagtccgcttgccttgcactgccttccgagtagccatgtaactacccacttaccatccttattcaactcatcttctatttgtagccagggagtaccactgtttttacctttcaattccaccgttcgtctatgtacgatggggagatatccgttgtgactggcaactattttgtcgtgccagcggtcagattcacatacttccaacatgcattgtgcacgcttgccccacaagaaagctcccaacatctgtgattggtcaatggctttacctgtccgattcagcaagcacagagtgttgtggttgatagttttcctgaaaacgttgcgcatgcccaagtcgcaatggtaaatgtaagtacctgggtcagccagcacgctcatcccgtccaccatcaactgcacgctcagcgcgtcggcatgtccatgggcggcaatacggccaaagcccaaagctgcatgatccatccctaccaaaatgcgaccagaagtatcacggaggaaagtgttcccacctacctcgaagcatctgctggctcgattgtcatacagtaccgccgaccttatctgcccgatggccttgttactgaacagccaaaatatattttcgtggatactgtcaaaggtatggtaccttttgccggtcagcagggagcagaactgtagaatgtagctgcagtgattccactcacccccttgcaagtctaagattttgccctcatcatcatcaccaaattccatgggctcctgttcgttccacaggctgtgagccacatattcggcttgcttgctcagcatcctgtaccatgtggttgggatttcatcatcatgtgcctgcatagccctcatcatcaggcaatatgcttccattccgaaggtttgatagtgcagggaaagttccttgttcacgccatcctcatagttctggttcagcagctccttcgatagtagtgccatacccagctccttccaaggtcggtaaccaaaggcatatccggctaacccaatggcagctgcttccaccaacaggtggttgttggctgaagaaaaacggctgtaatgacgggtcaagtagtccgtcatgttgataacacccgtccgcaacctttccgccagtttctcgtccttgcaaaaggccaaggttaccatccagttgacagccctgatagccacctccatgaccgatgtccatgctatcccatgcaagaaagtatgctgttcgcaccacctgtcttgttcgtcatttaggtaagcaagtagcctactgtcgcccgagacataagcagcctttgccagcaaggcgaaccggaaatgccgatgcttctcccaacaggtccgtgcatcacctaaatcatcccgctgcttgtatgtcagatcgtagctgaaggtgtccggccatttgccatagtccggaccttgcagacgatgtacttcagtaatggtagaataatgcgcgttgtccaagttgattcccaaagcacctgcatcgaagcccaactccctgagcgcatcattccacacctcaccgtccaccctgacgcgctgcttgccaaaacgtctcttttcagccttgacaagcaacctttgttgcaccctccagcacacctcctgcaagtccatagcctgaaggcggttcaagtaccaaaacagctttcccataattgttttctgtcgacctcagaactcagtccgtttaaagtcttgcgctacctgttcggcttgggcagggttcgtgttgatgcttccccatgacagaccttcatagtaaccgttgtagtccacctctttccattgccgtactagatcaatcacgaccttctgtggatagtcggccagcaggttggcaaactctttctccttgttggtcaccaccaacacatcactttcctgacataccgagtgcaggtcatccgtcacaaagtgttgtaaatgaggtatctttgccatgataaaatctttgttcgtacctgtcagttcgctgagtctcacattcttatcgtaaattctgatttcaaaacctttacccagcaattgctccactacatccacaatgggactacatcgcaggtcatccgtgcctgctttgaagctaagccccaatatacccactttgcgcttacctttactgataatcgtttcgacggcattcttcttctggttttcgttgctttggtagatgctctctatcaccggcacgtccacgtacagatcgcgcgccagtgttttcagtgctttcatatctttgggcagacacgaaccaccataggcgaagccgggtttaaagtaataaggcgagatatttagttgcttgtctttgcagaaaatctccatcactttgtgcgagtcgatgcccagccccttgcagatgtttcccacttcgttgccaaacacaatcttcaaagcatggtaagtgttatttacatacttcatcatttccgccaccttaatgtccgtacaaacaaattcagcatggatgtccttgtaaagttcgcgaagcttttgttcagccagtttattgtccgtgcccaccagtgtcagaggcggattgaaataatcttccacgcttgttccttcgcgcaggaattccggattactcaccacagtaaagtctacattgcgctttttgcccgacttctgttcgattatctctcccactttttggttcgtaccgggcagcactgtgctccgtatggctacgatatggaattcgtccttgtgttgcaatgcatggcctatccgccctgccaccgtatagatataatccagattcaaatgtccttccttactcgagggtgttcccaccacgataaaggatatttccgtctgtgccactgcttttgccgctacggttgtagccgtcatcagccctttatcgtgcgcttcttgacaaagttccgcaataccctcttctatgatggtcggcttcccttcgttcatcagtcgcactttgttctcgttcacgtccacaccgataaccttgtgtcctaatttggccaaacatgccgcgcccacgcatcctacgtagccgaggccgaaaatactaatgttcattcttttatatagctatttgatattcattgatcttaccttatggcataaaagtaactggcaacctatcttgacttagaccttgacaggttgcctatgggattgctatttttcgtgtttaatggaagaagagcggaaggtaggttattcccgaataaaattgatgatatatttgaatttgctactgttggttgtgaccaatttgtccatagtcgtttctatcaactccacatccagattgtctgtgccaacccgggctatgagggcagagataatcctgttgcgatcttcacttccaaagccttcttccggtatcaccaatacctttacttttcctgccctttcctgcaccaactgtgaggcttttacccgggttgcttctttcatgatgaagtccaacctctttagccgggttccgtctttgcagacgatatagtcctcaattctgccttgaatcctcttgatcaccccccccccgtttaacatttattagattaattatataattaaatttgcctcgtttgctgtaaaccagctcttggggacttatctggttaatccttatgttgaagttctgctcgccaagctgggcaaacacctcttcgtgcaatcgcttcatatcatcctgcgagaaaccaccatttaccactacgttcagcgtcacctccccctgcttctgctgtatgaattgggcattgtctatggacgtgatgttcttgaacacgcgggtcagcaatgcaccgctgtattgtgaaccgtcttttccaatgaggcatgtccctgcacgcccttcaatagacttcaccctgacctgccggttgctgtcatccagcttcatcagctccatcacatcgtttcccttataccttatcaaggggaaagattcgttaatcaatgaagtggttatctctccatcttcggtatattcattgatggaatagcctggttcctcgtaataaccattgtggttcaacgcttcgcttaggcggatggttcgttctgtagttccataatggtcatagacctgtgtgccaaattgtgtttctatcagcgcccgctgatagtccagcaatgattcgctcgaggtgaaagccaacgggatgtggagctgcagtcctctgtcacgcaacatgagggcaaggctgtacaaagaactcgggtatccttcaatcgccacaggcttgtgcttcaatatctggtcgtaatatgtctgtactgtttgtgagttgatattatagctcgataggtagagcgtgttgctgatatgtaccttcaggtaaagttctttcttctccaggtttccacgaagcgacaccaagggttgtccgtaaataaatccgcaccgcttccggtagcagtagaagtaagcctgttctctccaaatcgatggccagtcttcatacactttgagcggtgtccctgtagtgccgcttgtatggttggctatcagtttccatttgggtaccaccaacatttcatcagcatgctttttcaccatttctttggttattatcggaagcttctccatatcggtcaggctctttatatcttccagcccaatgccagtctctgtatacagcctgtgataaaaaggagatttccgataagcattcctgaatattcgcagaaacacttcttcattcctcctgttcaattcgtccgatgtcatgccatacattttctctatctcgaccacataaggcgatatgatgagtgggcatctgagcagatatttagcggtttcttttaggtattttttcattgatgtgtttacaatttatttgtttgtaggggagggaacctatgtcattcatttaacaaatgctttatatgggttatgtaatccagctctgataagtactttcctcacaaaacgcaataaattgcgagagacatagcttatgtattcattaaaaatattgggtacataacgtgtcctgagtgcaatatccaataatgatgcattctttaaataggaaagtagatatttgctaccagatatttgctccttaaacaaagcgaaatgtttttctatatctgccgataaatccactttcaacttatttgtctctttatcgaaatataattgatagagttggatattcttgccgtcccattccacaatcaactcatgctgtacttcaggttgtctgtaaaccaattttttattcccataaaaagtttgaggtaaaataaaatttccaagtgaataaactataggaacgcctttgtatatttcaactggctgaataacgtgagggtgatgccctactacaatatttgcgcctgcatccacgcagtcatgcgcgaactttctgtctgcgggttccggataatagaatttctccactccccaatgtggataaatcacaatgagtgcatcagggtcatgtcttcttattctgcgaatgtcacttaaaactctacttggattcatgagattcaagctatgttcattggaaaaagtggctaacgttatgatgtgaagattatgtccattgaattttatttttagcaggtcatggttttttaatccccaactgtctatgtcatttgattttagaagttctacagtctcatttatgtcttgtttgtagtccaatatgtgattattgcataaagacacatattttatgttcagcttcttgattatatcaagaacttggggggagctgtataacgaatatttatctgtccatttaggggcttctactgctgatttattgagcaatatagctccttccagatttgctattccaactgaacgttcaaataaagaacagatgtcactataatcaacatctacatcgaaagggcagactaagtctccacaaaatataatcttatccattgtcaattttgagaatccgtttgtataaagcaacgagtttaggaatttcaatatcaatattatggcaagtgcgaatatgcgtggatgctttttcactcatcctttcccacaatttcatatttatcttctttatctctgtagcatattcagcaccggtagcgtttttatccaagacaataccgcagtcagcgattacctccgcattaaaaccctgattggaagcaagaggtacaagcccatttgccattgattcaataagggagttcgattgcccctcaccaatatgtctggtagggaatacaaagaaatgcattttacccatttcttctttcaactgcgaaggagtaagcaatcctaaatatgtgatgttttcattttctacgatgtttaaatcaaaatccttatcaatattccctgccaaatacaaatgataatgtgtatcaagatagttcatcatgtccaataaaacatctatacccttactcattgtgatacgcccaaagtagaagatgctaaacttatcatgtgatcttgtctggattggaagattgtcgcatattgtcagattagggaaatagatggctttcgcatctatacccatcacttcctttatgtctcttatgtatgatgagctttctaccgttatgcaatcggctgatgacagcattgctcgcagtcttttttgtttcccttttcccttggtttgataatagtacagcaatgaccccgcccttacatcaaccaatacaggaattctacatgtccgagctattttcaataaaaagagagaggggcacaacagcttgccatacaagggggttgcgtgtatcaaaacattctttctccctatatattttgctaatatgaatggtttgaaatacagacttatataagccaatttcccgagtttaccccatttacggttaatgatgggattggaaaactcttcaacatcaatcctcagttgtctcagcttatctatgttctttctgttagctgcttcaaaaccacccagtgccggtttaccggattcagcaatgggtccgaaatataaaatcttcataactcaaaaatatttttactgcataaagacaaataaagcatatatgaaagtcttgggcttattctttatcagaagctaaaatcaaaactgcataacagccttatgtgtttgccctccccatcggtcggtaccgaaagcatgggggtaaccgaaaggttcccataagcgaacctcaaccccagcttacaccgttcctccttcatccgatactcagggacggtggaatattgcattaaaaacgtgatgcctttatagaggtgaatgtcagtacctgcggtaaagcaagtgagatagtccaaggcactgtcataatgagggttcactacaccggtcagcccccagccatcgagcaaacgccaatgcacatcaaccgccataccaaggttgtagaaatctccattataagaggtaccataataggggatggccttgatattccaattactccactgctgcttataactcaacaagaatcgtacatactgtgtactgaatttttgtgaaaacacgctatgttcgagcgtgacgttccattgctctttccatgtgtagccgatgtgcacatattggttgtcgcgcagacccactcccacttgggcgtacaggcacgaggcaaccaccgacacagccgcaaatgctaccaccctggtcattccgtttcttctcataacaatacctttttcagttcaccggaaatcaatgcatatccccattcgttcaggtgggtcccatcgtagaagtattgctcgttcagtctcccaccttccaggaaaaggtcgaatacatctatgtagacaacgttgtccaaccgttcggtcacaccttccctgattttcttgttcagcaaacgcactttctcatagccatcagactcaaatgccaaacgtggcaatattgaatacaggtagatacgcttcgcctccatgttttgcagcatccgcaggtaacgctccacataggcctccgtatcattcaccgaaaccacatcgttgcccccgattatcaacacaacattttctcccttgaactgcttgccctgcgactccacataatcgattccggcaccggatagccctgcgttgtacgtcacctttgtggggaagaacctgcgtacatcccacttctcaaccaaggaggaacctgtaaaaaagacggcttcgtccgtatcactgctacaggcagagaacgcgagtggcagaatcacggccaacagcaggacgccgatggagcggctttcaggaatccgttcagtcacaggacgaagctgcccattcgtccaccagataaggttttgtaccttctttccaactttcgttcttgaaaatatcatagtccagattctttgtccatcctattatcctggcaggattacccgccactattgcaccccgagggacactcttcgtgaccacggcattgggcgcaatgataacttcgtcttccacgactacaggaccttggataacagcacccgggcctacatataccctgtctttaagcaccggcacacatttgtacggtccttgccccacgatagacacattgttgccaatcttgcaacagtcacctatcacgacattcgaattgatgagcacaccgaaacctccatgattaaagaaagtccctttcccaatcttcaccttatagctgacagcactgctatagaacaagaaggctatcagctgcatcactttagggagcaaggggattttatgggtgttcatccaatgccctgccctgttgatgtctgccaaatttatcatatccttattacctatattagattctatctgagacgtaaaatctctttccactcataaccatctctattgtcgaacgtctgctggaagaagcggccgacacatcgtgtaatatatgccagcatcaggataatagccaacaagaccaatatattcagagggaacaatggcagcaaatcatcggtgtttccaccaaaaggcaaacaccgttcttctcctgtcaatatgggcatttgcaccaggtatatttcgaggcaaagcccgccgatggtcatgcccatgaaattccagcatcttcccttaaaaaatctttgcatgatttcagtattggccaatctatagaaataatagatgatacctatcagaggcaatacggtcagaacctgtagatgagcgacccatacatatctgttcccggcaatctggatgccatagaagagtaaagtgcaaaagagcaatacagatattatttgtatcatatttttaccccccccaattacagcttgaggctgttctttgctccttagccctatgatggcccctaaaagcatggacagaaaataacagaaccatttgatggtactgcctttgtacatccacaccatttccttatgctcaaacagaaagatataccacaaaacgataaagagaccaaccgccataaaaactgcattcagatggcaggaaaacagcttgcgcaccatgtatagcatgatatagctaagcatgatacaactgacaaactgtcctcctccactcagaatcacatgcagcatattgctggtagaggcaaagcatatggatgtaactaaggcaaagccaaatacggaaggatatatacgccgtattcttcgtttataccaggcatcaaaacgtcctatcctgcccaagaaaagtgtaaaaccgctacaaaagaagaacaaggcatcaccgatggcacctcctgtagagagtgccccataatcggcataaaccttttccatgtgcgaattggtaataagcaggacagcgaaaaattttaagatgtcaatactgaggtttcgtgaacgttccatataaaaataaaatttgcaatacctattgtttagcaagatagctcaactatcaacatcaggggataacattttaatgattttggcaggaacacctgcaacgacagcataagacggtacgtcgtgtgtaacaaccgagcctgcccctataatagcgtgatggcctatgtgtacattttcgactatacaacaccctgggccaatactgacaaaatcttcaattgtggctgctttccctttatttgaaccaatagtggtgaattgcccaatcgaacagtttttccctattcgtgcactgccattaatgacaacacctacgccatgactgatataaaatcctccgcctaatggcatccgatgtgaaatttgaatgccatattttgatgacagatgatgcaatatcaaccaacagaaaggttttaaaactccttccaccccacatagccttagccaaaatgtatagcaaaaacctctactatgtataaggacttttaaaatgtttaacaatttcaccccccccccctctaattcattgatatgcaatacaatccattgattgacaatataatcttgcttgattagcttccacatctctctatatgctcccatatcatatcgaatttatgagttgaatataatttttggcaaatatctccaatgaaaagcattgttcaaacaacagtctattgcttctttccaattcattttttagttcaaaatccatatcatatacattatggataagttgtgccgcctcttcaagttttgaatatgtaaagacaccttttgcaaaactcgacttgaaatatttgtttcctcctgtataactggcaatgataatctttcccaacgacaaaacctcaagcattaccaagtcaaaatacgtttccttattaggcagcatgaacacatcactggcatttattaaagagtgcggatctgatgtccatcccacttctatccacctcggatgatgaagcccgtgcaatggttcttcccgtcctgcaataaggaaatagatgtttggagcttcctgcaggatctgttctcctaacaattttagtttatcatatcctttaatttcattatgcctacccacatagcaaattataaaagcatcatcaggtattgaatatagctgacgaacctctgttttagacaatttagctacccgtgctttagtcccagtcaatagatacaagtattttcctttcttctcctcttttacggctttgtattcaggccagttattataataaggttcttccgcttccggacatggaaacacaatgtaatcagctcttcggaatgcatattcgtcaattttaatcagattcttataaagccaattcatgtgttttttttcccatgaagtcaatgcgtcatacatttctttggactgaatcgtaggggtgtgcgaagtcagcacaacggcccctttataacctttgagactgtcccttacattatacatatcaagagttgagtgaaagtggactgtatcgtatgcatttaaatcaacgagtgctttatgattaaagccatacagtgtcagaaacttccgatagacactcttcaatataataagaaagtttttaattctatcctgtttcaaggaatgaattctgctgttcacattttgatttatactagtctcacgatggatataatggatattggtaacacccaaattgtccaattctttctttaagaaataattatatcccaactttccccctcggggagacatcatacagtcaacaatataaactaaaatatttttcataatcagtttttaaagtatataaactatctacactctatatttttattatgtaatcccaatacatgcaactttatatactggggtatagaataaaaaaacagatagaataaagcgtataatttaacagatagcaatgggacaaagcatatacaatacgtaagggataaaactgaatttttagcaagacataaagccaaacttttatctatatagcgtttatcaaatcccatttctacaagtttatgataagcacacttaaatccttcaaagtcttttactcgtaaaaacgaatacaatgccttaaagtgtctgtcgtcatgtatgggtacatcgtgatttaaaaaaaataaatctttctgaccaaacacatctattctcacataaaatttccatttctgattaggcaatgcactgatagagccacttcttacagtgtaagtatataatgcccttgaatctacttgaatttttttagcataatacccaaccaaataagaaaatttcgtatcattgtggacacgtgtttcatcaaataatataccattattggttaacaaattcctgcgtaccattttacaccaaggttcaccaaagatatatcttaaatacaattcagcgacatgagaatctgaattccataaactgatgtattggtttaagtgttttgatttggattgctgcacataggtctgactgtctacactatttgcattaaaaaaaatcaaatccgcatctacagccgcatattcatcaagaatatcattaatgcaataattaaaataatcatctgcatctgcaaataacaaccacgttccgcaggcatgagacaatcctacatttctagcataaccagctccacctccttctttagtaaagtataattcaacattcgcccgattacatccaggaaagtttccaaaatcgacttcagattcatcactattgtcatctacaacaataatttgcaaatcacttctttggggaattgaatccaaacagcgttgcaacaaattaggagcatttttatggggtataattatactgtaattaaatgcattcattagaaaatatatttgttacgtattcatccgaaatcttcagagccttcaactgctattcaaataatttgttttgatttttccgtcttacaatcagggaaaatcataaattacctaatgggtaaatagtttctacctccagcatcccatataaacatcatgtcaaaaacattttctgttttccataacaaactaagagttggccaaacagaaacaaacaagcctaacatagcaataataaaatacaacagtgattgagtattcctatttttgtatgcttgataaaagtaaacaccacagacaacacaagaaaaaaacgcaaaagaagacgcatatctatctaaaatttccactaaacaaattggtctcagaatagcacctattacaaataggttataaaagaatataccatactttattttatcaatgtaattccgcataaaatatacagtagggataaaggcaatcaatggtctaatcttattcatgattgagcgctcataaagtcctaaacgtccaaagtctccatttattaaatcttgggttgaattaagatatatgtctgctttctctccactaccaactaaacccaagcctaaaaattgagaacttaaatttattaaaaaagtaaatgaagacaaactgagtataaaagatgttgcaaacattaaaacaattgctattataggtggaatcgtccttctatttataaaaggtgcaaacactattataggtgctaaaacaattataccaaaatgtataaaaaaggcacatagaaaccataataatgcccacgcattatttttatgtaaatatgaattaagtgataaaataaaaaaactaaatgcaaaccaccatcgtatgtaacaatcatttgtagaaattagaggcaatagcagtggcagtataaaaggcaaatattgcctgaaatttctaagaaaaacaagtattgtaaacatcaaaaaagcacattgaagaaatatgaacatataatatggtatgcctatattgtagaataaatggcataacatagagaacaagaactcataatcttcattatgtaagctttctcctagagctttataccggaaataatataaattccaatctatatcacgaccgaatcgtaacccgtaagttagtgcataagttaaaatagggaatatagatgccaaataatattctttaaaagtccctttctttgctaatattttaccataaaaaagaaatacaaagaaacagaatccattgattagtatatacgtagttataatatcagacattatatatagttttacatttattgaacaaatagctattatcaagcaatttatatagtagatgccagtttgtctatcacactccaaataggtattagtattttatcaatcactatgcatgccggcataaccactaatgtatacacaaccaacacctacgtcagaacgccgtaattaatagcagcctattccatccaaagtatcaatttcccgatataatgcaagataaaagggtgcgaatgtatcaaatatataaccagcgttggttataaaagctaaataaagaaagaacagaaacaaatagtataacgtcatgaaaaattgggcgatgacgctaatcaacccctatgaactctctctacgtgatacgattcctttattcaccttattttcaatattctgtttttaatccttttatttatagcccaccgttcttgatttgtgatgcccaccagatagataatcaaccccgtgcttgaacaggcaatcagggaagttatgacaaatgacaggaaacttatatcaaacatggattttatgtaggaggctgtcacaaggcagacagccgctatgaacagatttttcaggacaatggaaaaggtgaaaaatctcaatctgtatgtcggtataagtttttttagtatcaggaatcgtgcaaacagaccgataaaactgaccagtacagccgggtacattgcctggtaagggcttcctccgcaggctaaaatgagatacgccaacggcagttcgcataacatgatgacacaaatgacaatctgaaatacttttatgttccctgtagcctgcaacgcagtcacaacaggagataccatgacattcaccaaagcagcaatcaatgcaagcatcaggaattggggtgtatattgaggaaccgttttcagccataatcgcaacaggtaatccatgttgatgaaaacagggattactatcataagtagtaagaaaaaagagaacctgcatcccaggtaaaccaactccatcgaggccttggtgccacctgccgcatattgcttggtgatttggggattcaaggccatggtgaagttgttggaaaaattgctgataatgccattgacttgcatggcaattccgcgtgcggcattgaccgctgtgtcgaaaaacaggttcaatatgatattcgacccttgatctttcatagaaaaccccagatttccaatgacactccagcctgcaaaagcaaacatctctttaaaaagcttcctgtccaaaacaaatcgataggtgcattcctcgaaataccgtttgcaatagatgccgtaaatgattcggatgacgaaagctacagcagctaccaagatagcatataaaaccaacttgtctacagcacctaccaatagcaagtaaaccaccagaagtttcaggacagcttcaaggatgctgacgtatgcaaacgctttcatgtgctcgtgggcaacaatgcacgaattgtacggtacgcttaccactgtcagcatcagggtcagaatggaacactggtatacccagttggccgcccccatcctttcagcaggaatgttcaggtgggtattcacaaaccacagtccgagtgtttcagctatcaggaatatgataagagccaatacgatatgaatcgagacagaagtgcagaatactttcttcaatctctctgaatcgtttgtccctaactcgaatgaaatgaaacgctgcgaagccgcgaccatggcggaattaagaaaggcaagcatcgagacaatgcctcccacaacattataaattccataatcacttactcctaacgtgttaagcaccacgcgactggtgtataacccaaccgcaatagtaagcaacatgcggaagtaaagcaatagggtattttttgctatgcgcttattgctggaagttgccattattgacctataaacttataataatgcatattggctatattgccaagtctaattacataactccaaactggttgcaatgccttatcaacgaagatgcttacaaacattatcaccaaggtataacagataatcagaagtaaaaacgaaacattatcgaacgaccaatcctttaataccggaatggctttgcctattacattaagaatcacaggctgtgaatgtatgaggtatatggccaaagttgaagatgcaagatagtttatttttgtagaccgtaaacgtatctttccgataatcaagaacatcagcaacgcatttactaaaagtatcggactgcaataaggatagcttagtatccatatagccttgcccatgattgaatttgagccaactgataagtatgaaactaccaatgcgatatttatccccataaagatagggacaagttgtgaatatttaaatcttttccaatagtatttgtatctgttcaaagtattgcctattacgtataaaaaaataaagttagcaagattcttgccatcttgcaatgacgggtctccatgtgatgtgccaagataagtgcttatgaaaaataagaaagccaaaagcagaattcttttctgtacaacgttcagatacagattgattattggcgcgaaaatgaaaagacaaatataagttcgcataaaccaatatggagtatgtgaaataaagagtaatgtttttaatatttcttttaaattaccccccccagaatgtaaataaatataaacaagctgaataggaaggtaatatacaaacatcatacctattagtttcagtaatccttttggagttgcctttattccaaaatatccactgattaacacaaatagcagaacgccaatgtgtaaaggtatttgaattgctttataaaaatcattttcataaagtggatgcaagaagaacaaaaagagatgataaagcactattaaaaacatcgataccaaacgcataagttcaaaagaactctcacgttgtttacaaaccgtttttgttttcatataaaatcaatcccttctaaaaatatcccgtgtatacactttctctttcacatcatctaaacaagcgtcataacggttagcgataatcgcctggctctgtgctttaaatgcgttcaggtcgttcaccactttactaccgaaaaaagtacttccatcctgcaaagtcggttcgtagataattacttctgcaccttttgcctttacccgcttcatcacaccttgtatggaagattggcggaaattatcactgttcgacttcatcgtcaggcggtaaacgcctatgacacatttcttttcttctgatggattgaaatcgccacggttgtaataatcgtaataacctgccatgtgaagcacacggtcggcaatgaagtctttccttgtccggttgctttctacaatcgcttgtatcaggttctccggcacatcggcatagttggcaagtagctgcttggtgtccttgggcaggcaataaccgccatagccgaagctcgggttgttgtagtgcgtgccgattcgtggatcgaggcttacgccgtcgatgatggctttcgtgtccaggcccttcatttcggcataggtgtcaagctcgttgaagtagctgacgcgcagggcgaggtaggtgttggcgaagagtttcaccgcctccgcttccgtcaggcccatgaagagggtatcgatgttctcctttatcgccccttcctgtagcaaggccgcaaaggtacgggcggcttcgtcaaggcgtgcgtcgccttcgggacggcccacgatgatgcggctgggatagaggttgtcatacaatgccttgctttcgcgcaggaattcgggcgagaagatgacgttctccgtgtctaatttcctgcgcacactttccgtgtagcccacaggaatggtacttttaatcaccataacggcacaaggattgacgctcttcaccaactcaatgacttcttctacatggctggtgtcgaagtagttcttcaccgggtcgtagttcgtcggtgcggcaataaccacaaagtctgcgtcggcatatgccttcgctccatctaaggtggcagtcaggttcaattctttttcagtaagatacttctcaatgtattcgtcctgtatgggcgatttacgccgatttatcagttctaccttttcaggaatcacgtcaacagccgtcacttggtgatgttgtgccagcagtgtggcaatggaaagtcctacgtaaccggttccggctacggctatttttatattcttatccatgattattattttatttgtcttttcatgtgaccaattgtattttctccgtcttttactacaagcatctctcatgagttcgcactgagaaaccatagaaggccgtttttcctgtattaatgaaagaaactaggtatgacataataaaggtttatttcattattcttgtttacaatataaccgcctactgttacttctatttcaggattgcctttcatatattctttaattacaggaacagccattagaactgtgactacggctgctgtaaatgaccaaaatttgtaggaaagcagttttgaaaatgcctttctcatcattcgatacatattcattattcagattaataattcattcaccggcattgccaccccgctcaaacatcccgatgtcctttccataagttttattccgtctctctaaacaatagtccgtggtgtgggacaggggtatgttattaagcatatgaccttttttactggttatgattcactacaatttttaattcgttgtgtgaaaccaggcgtttacagcgaagggactattcaaagtcacaaatttacaaacaggactggtagatcaccctttatggcagtttcactactaccttgtttccggatacctttgttcctgtgacatcgcctttcatgctgatttctatatcagagtattgcggttcaatcatcattgtgccgtcaatggcaatgacaccccactggctgtaattcttctctacggcgcaatacctgcctatgggaggcctgacattgcggtatatcggaggaatggtgatacgctcaccgactttcagcccccatttcatccctgaacggaacggaacagcctcgcctgacttttccagaagcagccgcctctttttcattttctcggattccgccatattccgtatctccctcgcatgctttgccagtcgctccatcgcggccaaacatttctctccctcctctgccgggaagtgacatccgatgtattttttttccccacagtctgtcacatgatagtatttccctccgatgtccgtcacgatgatgcttccatccgccaaccatcggcatatccaatagtaactgtcatgatcaccaccgaggagacaggcatatccccatggaaaaccagccatatgcggatcgtcaatatagcattggacggaagcattataatcaaaaatcgccacatagaacttgtggtcataaatatagccgccgctcaggttcagtttgcttgcatacagattttttgtacggctataatacatgcgaccgactttcaacatctccacatccccgaaacgcttcacctcgggtttttccctgtatgaccgcaggttgtaaagatctatataatcagatctgccgttcggtttctgcacggtcaggaaattgtttctcatgaatttcatggactggcaatacccttccttccttataatctcaccacaggcgtttaccagtccgcagttcttgtccgagagcctcaccgctgccatgtcatgccggatatcgaagactgtgacgaataccggggccgtaatcttatttcttccccggcacagcccccataacccgctgttcttgtcgtgccatgctctaagttccggcctcttgcagggattaggagttttttgcaaagctatagcggaaagcagcctgtcatgggaaacgatcatttccataccgaagtcctgacatgaatcttccgcggtgacagtttccggacttgttccgtttccatgccggacggtccgtattccccttccagccatatccccacggaacatcgcttcccagtcccatgccatggtgggcagaccgaacacacggtaaagccccacgttgtctatcagcacacatgtttccttaccggttgattttctcagtccgcgcccggcctgttgcagatatttggccagcgagagtgtcgggcgcgccatctgcacgaactccacatcggggcagtcaaatccctcgctgaaaacgtccacatttaccagtacccttattctgcctgtcttgaaatcctccaccatccgtccgcgttcagcagccggtgtgtgactgtctatggctgcggcgtccagtccttttccactgtaatacgccgcgatgttccgcgcatggtcgatactgacggcatagacgatccccttcttcccgtccgcatactccagaacgctccggtataaccgttcgatgcttgtgtggcgattcagtacatcattcatctcccttatctgataatcaccgtcggcaccgcgtttttccagcgagtctattaaccgttgttccctgctatttgcacgtatcgagacataatcaaatgacgacagccatcctttccttataaactccgccacactccacgagcataccagcgagtcgaaaaggtctgtgaatccagaacgtcccatccgacagggagtggcggtaagtccgagaaacttcgcttccggacacctgctccatagtatccgataagtccttgcctgcgcatggtgcgcctcgtcgatgatgaccagttccggtttttccaccacatcatcgtaatgccgtgtgagccattgtatggacatcaccctgatgcacccgtcagtcagacttgtcccgtattttgcaacggtctcttcaatctgcgccacaagctccctgcggtgtgcgacgatccagaccgtcctctttccatcagtgaggaaactgcttaccaccgccgccaatacatgggtcttgccggtacctgtgggcatctgcaccatcacgctgcgatgcgttagccactcctccgagagacggcgcatgatgtctttctgatagtcatgcagacatacggtttttgccatatcgttttcgattaaagctccgggaacaagcgctctcgttcccggagctccccctgcacttttcaattcagtaactttatagccaactccttgtcggctatcgcggcatactgcttttttgaaaagaagcccgccattgacgtaaagtttgtcaatgacggacaacttgctattttttgattttatttcgaactcacgttattaatgttataactgtacgattacaccggaaattccatatcaaagacaaggacgttttttaaaaagatcaagagctttttaaaaaagaacaggagctttttcaaaaacaacaggatgtttttgatgcttttctactcgtattgcataacatggcaaaataccttgtttttctttcagaagtttcagcttctccgcaaacgtcctgttcatcggcttttcggctgaaggatatacacgataaaatccttcagccgaaaaagatctttcagcgtgacagggtaagcgatgtcgtattggttggttttctatcggtattcggatttacctttatacatttattgactacggctgaaagaaagaactacgcggttgaaggatctcggtgcatcaatctgtcagccggaatgccgatgaacaggacgtttgcggagaggctgaaacttctgaaggatttttgggggcattcttcaagagaggggtatttctcttcaaaagatggatacgcatatcaaaaagaaggtggaaagactttgaaaacttgtcgcaagatgtcgcaattcttgtagcaagtttttcggaatcttgtagcaggatttgcagattcttggtataggaatatcttgtttgattttatagctgtccggtaaaaatgccgaagttcccccaaaaaggtctagctttgggataaacagattcggttttaatggtaaacaaatatgattgtatcattccacaaacatgtagcttgtttgcgatatatattccgataattttagtatattttgtagaatgtgtctgtgcaaattagacgtagcatttaccgtctgtgaaaagtgggatacttattattgaacctgaatccgaatcccagcatcagatagttgggatcatggaaatcctgtaaattatatccgatatgaaggaatgagttgcgcgtaacttctatcttcagtgccaatatctggtagaaagattttaaatctccgcctgcatgaatcacatttgtacccaatcctattcctactgtgaagtaaggcatcacgtactcggcacgtcccgaaactcccagtgccagttgtttgccggcagacggcttgaggagctcatcgccgtatccgtccgggctatacacattcgcactgccgtcataaaccccgtctaatgaaatacccgcacggaatttatacccgaaattatacattggcgcgaaattaaatcccagtaccggataagtttcaggagaagcaaccatttgcccctctccaatcgttactccttttctgcgccatgaaccgaacaataccaggtcataactgatatgacggggaaatttaggtacgggtgattgatacaagggctttgcaaaacattcttcttttctattgatattgtaaaccaatcctacctttagtccgatggaattgagtcccgcattcgggaatttggtattaccgttagagaaatgcgttactgccacacctgttgtgaaatcaaatttgggagaaagcatccagttgaaatagaagtttgtattcagataggcgtttactttcgaacctatcactttattatatggattcaaatcgctgtggtatggtttccagccaaatgaagcgccgaaattccattcatagtttaatgacaatcgttggttgaaacgggcgatacgcgctccttgaaataaatagacagtaagcgggttgcccaattgcggcttctcatacatattgtagtagcccacgccaataccttggtaggcccctctgtaaatacggtcgttataggtgttcggatgaaactggaatgagtacttcaagtgaagcgacagggaattctctatgggtttccaattcagattttctcctctgaaaaaggaactggtggggaaaatatatccgggacgtgcctcaatgccgatacggtggataaaatgacgtttcaatgacagggaatctacataaagccggtcggggatgttggttttgtctgaaatggaaaccgctgttgtgtctatagggtttccctctgtatattgattgattgtgtctttagcaaaggtcatgttacttaagaacagtaatgcatccagaagtatcacgagtttccatttttgtattgtgcctttcatatgccgtgtaatgtttttgtgcgttttaccgatctatcgtatggtctgatttttttatttgtggcacaaatataatcatagtatttgaaaaaagaaatttgttagatataaaaaggttttgtataaccttgataaccactatttaaactattttgaggatggattgtaatgtcatcctctaccatcggctccccacatcattttattgcggagtgtgttgaaaaagatatggctgtttcgttttactacatttattttatagtcggctttgcggatagtgagccggcttccttcacggcaagtttcgctacgtccgtcgatggcaatcaggaaattgtggctgcggctctctatatccaatgtgatttcccagtcgtcgttgatgacaatggggcgtacattcaggctatgcggtgctaccggagtgatggcgatggtgttgctgtgtggcacgatgacaggtcccccgatgctcagcgaataggctgtagaaccggtaggagtggcgatgaccagcccgtccgcctggtaggtggtgagataggctccattgatggctgtgtggatggaaatcatggaagaactgtcacgcttcagtaccgctatctcattcagaccgaaagggtaacctttcagttcctgttctttgcaggatacttgcaatacgctgcggtcttctatccggtagtttccattgtagatgtcattgaatgtgtcttccatctcttcaggagaaacatcagccagaaaacctaatcgtccggtgttgatacctagtatgggaatgttgcgtgaccccacacggctggcggctttcaggaaagtgccgtcgcctccgatacttagtatcatgtcggcttcaaaattatttccatcgaaaacaccggcgtgacggatgcttatcttgaggtcgtccgtcagaaactcgtagaactcccggcagatgtgaacttcagcgttatgttgtgatagaatggatagcaaacgttccacatgagccgatttcttggcttgataagtgtttccgaaaagggcgaatttcattgggcgtatattcattagttaattttataaatcttttgtttgtcaaaatggaccaggttttaataaaacctgctaactttgcacatcagaactgcaaagataataatatattgccaagatgacaaagttaagtgtaaatataaacaaggtagccaccttgcgtaatgcccggggaggcaacaatccggacgtggtgaaagtagccttggactgtgaggcgtttggtgcggaaggtatcactgtacatccccgtcccgatgaacggcatatccgccgcagcgatgtgtacgaacttcgtccgctgcttaccacagagtttaacattgaagggtatccctcaccggagttcgttgatctggtgctgaaagtgaaacctcatcaagtaacgttggtgcccgatgcgcccgatcagattacgtctaatgccggatgggataccaagaccaatctttctttccttaccgaactgatggatacgttcggccaggcaggtatccgcacctctatctttgtcggtacggacaaggagatgatagaatatgccgccaaagcgggagccgaccgggtggaactttatacggaaccatacgctacgatgtaccctcggaatcccgaagcggccattgctccttttatagaagcggcgaaggtgacacgtagcctgggaatggggctgaatgcaggtcatgaccttagtctggtgaatctgaaatatatgcatacgcatattccttggctggacgaggtgtctatcggtcatgcattgataagcgatgcgctttatatgggattaaaacaaactattgaagaatataaaaattgtcttcgttcatgatgaatatcactttactggctgcacaggcggctttggcggatacccttgccgggggtaatcccgtattgactcccgtttcagaggaggctcggatgaatctttgggatatggcgatgaaaggtggatggatcatgcttgtgctggcattgttgtctgtcgtctgtttttatattttctttgaacgcatggcggttatccgcaaggcggggaaggatgatcctttgtttatggaacgtattcgtgattatatccgcacgggtgagataaagtcggctataaactattgccgcatcaccaatactccttctgcccgtatgattgagaaaggtattacccgtatgggacgtcctgttgccgatgtgcaggctgctatcgaaaattccggcaatatagaagtggcaaaactggagaacggactgcctgttgtggcgactattgccggcggtgctccgatgattggtttccttggtactgtaaccggtatggtgcaggctttttgggaaatgtccaatgccgggaacaacattgatatcacgttgctttcaggaggtatttatgaagcgatgattactactgtgggtggtctggttgtgggtattgcggctatgtttgcctataattatctggtaacccgtgtggacaaggtggtaagtcaaatggaagcgcgtaccatggacttcatggatttactgaacgaacccgttcaaaagtaatagcgtatggcactgaaaagaagacataaaatatcacctaacttcagtatggcgtctatgacagacatcatattcctgttgctgatattcttcatgattacctctaccatggtgtcgcccaatgccatcaaggtattgcttccgcaaggcaggcagcagacttcggcaaagccgcttacgagggtaatcattgacaagaacctgaacttctatactgctttcggcaatgaggatgaaatgccgatagacttggaagaactgcccgcattcctgcaaaggtgtgccgagaaggaacccgatatgtatgtggctctttatgcggatgaggctgtgccttaccgcgaaatagtaagggtactgaatattgctaatgaaaatcacttcaagatggtgttggctacacgtccgcctgagaagaaacgttaagctgtaagcatgaagaaaaataagataacaggactgattggtacggctgtactgcatatacttctccttatcctgctgctggtgattgctatccgccgtccgcaggttcaggaagaggggggtgttcctgttatgctgggaaatacagagctttctcaagggaatgccgacccttatacgctgacggatatagatataatgaatgagcctgaggctccggctcccgatgtatctgaaccggaaacggttcctcccgttgaagcgaaagaggaaatcatcacgcagacagaagaggaaacggtggcagtccctaaaaaggaacctaaaaaagaaacccctaaaaaagaaaaacccaagaaggaaactcctaaaaaggacgtaccgaaaaaggaggcggtgaagccgaaagagaagactgaggccgagaaacgcgctgaagcagaaaaagcggcggctgagaagaaagcggctgccgaaagggcggcagcggaagcggcggcgaagaagatagccggtgcttttggcaagggaactcaaatgggaaataaaggaaccggtaccacaggctccggtctggagggtagtccgacgggagactcttcggaagggaagtccggcggagtgggcggttacggaacatttgacctcaacggacgttctttgggtagtggcggtttgccgatgcctgtctataatgtgcaggatgagggacgggtggtagtgactattaccgtaaatcccgcaggacaggtgataagtaccagtatcaacaaacgtaccaatacagtaaacgcttcgttgcggaaggcggcggaagaggccgcccgtaaagcacgctttaaccaagtggacggagtgaataaccagacaggtactattacatattactttaaactgaagtagcttatgaaaacaatttatgtatttttggcagaaggcttcgaggaagtggaggcgctgaccccggtagatgtgttgagacgtgcaggtttgcctgtgaagactgtttccgtaacaggtgtgctgaccgtaaacggtgcgcatggtgttccggtagtagccgatatggtgtttgaagaagtaaaagaaggggatgcggagatgattgtattgcctggtggtctgcccggagcgacaaatctggatgctcacgaaggtttgggcaagttgattatgacatttgctgaagccggacgtccgttgtctgccatctgtgccgctccgttggtatatggaaagcgtggtttgttgaaaggtaagaaagtaacttgctatccgggattcgaaaagtatctggaaggtgctgagtatacggccgctttgatagagaaagacggtaattttattaccggtaaaggccccggtgccgctatggcattctcatttgccattgccgagaaatatgtcggtgcggaaaaggtgacagaattgaagcaagggatgatgattgcagaatgaacaggcatgtcattatagttgcaggaggcaaagggttgcgtatgggaggggatattcccaaacagtttttgcctgtagggggcaaacctgtgttgatgcgtaccatagaggctttttacgcttttgattcttctatgcatattatattagttcttccggtgagccagcaggcttactggaaagatctttgtgaaacgtatcattttgctttgcgtcatgatattgccgatgggggcgagactcgtttccattctgtaaagaatggattggcatacgtgaagggagaaggcttggtaggtgttcatgatggcgtgcgtccttttgtttcccgggaagtgatagccggatgttatgaggcagcgcagactaagcaagcggttattcctgtaattgatgtggtggaaaccgtgcgtcatcttacgaagccgggaagtgaaacggttccgcgtaatgactataaactggttcagactcctcaggtctttgaagtgcagttattgaaagaggcatatcaacaggaatatacggatgcctttactgatgatgcttctgtagtggaggcgatgggcagggaggtctgtctggtgcagggaaatagagaaaatattaaattaaccaccccttttgatttgaaaatagcggaagtcttaatttgaaatgttcgatatcactacgcgtgacataaaatatttgcaaggagtaggcccgcagcgtgcaaccgtcttgaacaaggaattgaatcttttttccttgcatgatttgttgtactattttccatataaatatgtagaccgcagccgcctttattatatccatgaaatagacggaaatatgccttatatccagttgaaaggcgaaatcctcagttttgagactttgggtgagggaagacagcgcagacttgtcggtcatttttctgatggtacgggcatcattgatttagtctggtttcaaggaattaaatatctgctagagcattataagaccaggacagagtatattgtctttggtaaaccgaccgtattcaatggccgtatcaatgtggctcatcccgatatggatccttcaggcgaacttaccttatctacgatggggttgcagccttattataacacaacggaaaggatgaagcgcggtttcttgaactctcatgggctggagaagttgatgaagaatgcgcttgccctgctacaggaacctcttgctgaaacattgccccctcggttagtggaggagcatcatttaatgtctttggatgaggccatccgtaatattcatttccccaagaatcccgaattgctgcggaaggcccaatatcgtttgaagtttgaagagctgttctatgtgcagctcaatattctacgttacagtaaagacaggcagcgtaaatatcggggcctgcgttttgaacgggtgggtgagatctttaatactttttattcacagaatcttccttttgaactgaccggagcgcaaaaacgggtgataaaggagataagaaaagatatgggaagcggacggcagatgaaccgtttgctgcaaggtgacgtaggaagtgggaaaacattggtggccttgatgtccatgcttatcgcactggataatggctatcaggcatgtatgatggctcctacagagattcttgccgcccagcattatgaaaccattcggaaattcctgtttggcatggatgtgcgcgtggaacttttaatgggatctgtcaaaggaaagaagcgtgagaagatattgaaggatttgctgacgggggatgttcagattcttataggcacgcatgccgttttggaagatactgtgggtttttcttctttaggaatggtgattatagacgagcaacatcgtttcggagtggctcagcgtgccaagttatggagcaagaatgtttgtccgcctcatgtgctggtcatgacggctacccctattccccgtaccttggctatgacactgtatggtgatcttgatgtatcagttattgacgaattgccgccgggccgtaaacccatccagactatccatcagtttgacaatcgccgtgccagtctttatgcttccattcgcaaacagatagaagaagggcggcaaatctatattgtttatcctttgataaaggagagtgaaaaaatggatatcaagaatctggaagaggggtatgaactgatttgtgcggaatttcccgattgccaggtcagcaaggtgcatggtaagatgaaaccggcggagaaggatgctgagatgcagcgtttcgttagtggtgaaacccagattatggtggccactacagtgattgaggtcggggtgaatgtcccgaatgcctcggtgatggtcattgaaaacgccgaacgtttcggactttcacaattgcatcagttgcgtgggcgtgtgggacgtggagctgatcagtcttattgtattttggtcaccacttacaaactgaccgaagaaactcgcaagcggcttgaaataatggtacagaccaatgatggtttcgagatagcggaagccgatttgaagttgcgcggtcccggtgacttggagggaacccagcagagtggtgtcgcttttgacttgaagatagccgatattgcccgtgacggtcaattattgcaatatgtccgtgatgtggcaaatcgtattgtagatgaagaccctgcaggaactcgtccggaaaatgctattctttggcagcaattgcaagcattgcgtaaaacaaatataaattgggcggctatctcttagtttatgttactgcattgttaaaagcaaggatatatgttgcataacatgtttgtagcgtttcccctttatttatagaggtttctgaacattttatcgaagcattgtatataacttacatacaaaaagagttaaagaagttccttctttctcaaggaaaatctttatctttggaagaatttttggaaaaagcacagtataaaccttaaatgaacccaatattatgatggaaaaaacgctggttattttgaaaccttgcactctgcagaggggcttggtgggtgagattattaatagatttgaaagaaaaggcctgcgtttagccggaatgaaaatggttcaattgacggatgaagtgcttagcgaacattacgctcatttgagttcaaagccgttctttcagcgagtgaaagatgcaatgatggtttgtcctgttattgtatgctgctttgaaggtgtggacgctgtccaagtagtgagaacattaaccggtcctactaacggacgtctggcggctcccggtactatccgtggagattacagcatgagctttcaagagaatatagttcatgcttccgattcgccggaaaccgctgaagtggaacttaaacgattttttaaaccagaagagatattcgagtataagcaagccgtgttcggttccctttatgctaatgacgaatattaaaaagaaaaacctaaaaaaacggatgattttgaaatgtgttaaagtagtcgcagcggcagccttcgccctggttagcctgaatgtgtcaggacaggatctgttggcacgccaggcacctatcgaccgaaaattgaaagcagtagattctgttgcattgattcgtcagataaaggcggaaaagtcagcttatcctgcatatagtctctaccctaattggagtaacgagcgtgtacacgcttatggtaatactgttactattcctgatacattccgtattgatatgaccggtttccgtatgccgacagaacacacaaaaataacttctaaatttggtccccgtcgtcgtcgtatgcacaatggattggatataaaagtatatataggtgatacgatccgtgcagctttcagtggaaaggtacgtatggtgaagtatgaacgccgcggatatggaaaatatgtggtgattcgtcacgagaatggattggaaacagtatatggtcacttgtcaaagcagattgtggatgagaaccagtacgtagaagcaggagaacctatcggattgggtggaaacaccggacgttccaccgggtcacatcttcattttgaaacgcgtttcttgggacaggccattaatccggcattgttatttgattttgagaaacaggatattgtagccgattcttatttgttcagaaaaggtaataacagataccagcgtaacaggactaatagtaagaatgtgaatttgcttgcttcatcagatggtactatccgttaccataaggtaagaagtggggatacattgagccgcattgcacagaaaacaggtacatctattgatgctttatgcaagttgaaccacattacccgcagaactattcttcgtccgggacaagtgttaagatgttcttaagctttagttaattaagaaatataaaatagggcgggaaagagtattcttttccgcctttttgtttacgcttaagcagaaaaatgcgtaactttgccgcctaatcatagagtgtgatgaaagatacgaaacaacaatttgaacatgtgatagctatttgccgtgatttgtttgcgaaaaaactgcacgattacggtgcagcatggcgtatcatgcgcccttcatctgttaccgatcagatatttatcaaggcaaaccgtattcgtagcattgaaaccaaaggggtggcgatggtggatgaaggtatccgttcggagtttatcgctattgtaaattatggaataatcggcttggtccaattggaactgggatatgctgaaacggatgacatgactgaagagcgtgctttggaattgtatgaccggtatgccaaacaggctttggaactgatgttggccaaaaatcatgattatgacgaagcgtggcgcagcatgcgtgtcagttcgtatactgatttgattttgatgaaaatctatcgtaccaagcagattgaaggtcacgatggagctacattggtatcagagggcattgatgccaactatatggatatgattaattattctgtattcggattgatcaagttggaatttggagagtaaacagttacatagtatcattggaatctggacaaacgcctgccgttttttgctggcggcagtatttatattttccggttttgtcaaagcggtagatccgctgggtactcaatataaaattcaggattatttggaggttttcggttgggctgcttcggtgcctgcctttcttccgtttctggcgtctgtattgcaggcaatggtcgagttttgtttaggagtatatcttttgtttggtatccgcaggagaatgaccaccttgtttgttgtgcttatcatgggggtgatgactccgctcaccttatggttggctctttccaatccgatatcggattgtggatgtttcggtgatgctgtgactttgactaattgggaaacttttgggaagaatgtacttttgttgatagcggcggtgtccgtttttaaatggggaaaccgtataactcctttggtgaccaagcgtttcgattggttggtggctatgtatacgtttctctatatttcggggatgactttgtattgttaccgtgagttgcctgtctttgatttccgcccttatcatatcggggcagatatacgtaaagggatggaaattccggaaggagagaagcctactgtttatgagacccgttttattcttcaaaaagatggagtggagaaagagtttacattagaaaattatcctgatagcacatggacttttgtggattccaaaacgatggtgaaggaacaaggatacgaaccgcctattcatgacttttccattattcgtcaagaagacggggaagatataaccgatgaagtactggatgatgataattatacctttctgttggtggcgcatcagctgagccaggcggatgatagtaccattgacctgataaatgaactgtatgattatagtgtggagcatggatatcaattctattgtcttacctcatcacccgatagtgatattgaagactggcaggagcgtacgggagccgagtatcctttctgcctgatggatgacattacactgaaaaccatgatacgctctaatcccggactgatgttgctgaagaacggagtggttataaacaagtggagtgtgaatagtctgcccgatgaatatgtgctgaccgacaggctggaaaaactgcctttggcacaaatcaatgaaaagactttcagtcataaagtggtgctggtattggcatggtttgtctttccgttgttgtttttcagcatggtggatgtcatttgggagcattttcataggaaaaagaaattgaaagagaatcgaacaaaataatttcattaaccctttaataaaacaaacaaaatgagaaaaaacattgttgcaggaaactggaaaatgaacaagaaccttcaggaaggtattgctctggcaaaagaattgaatgaagctttggctgctgacaaacctaattgtgatgtggtaatctgtactccgtttattcacttggcttctgttactcctattgttgacaaggctgtaattggtgtaggtgcagaaaactgtgcagataaagtatcaggtgcatataccggtgaggtttctgctgaaatggtagcttctacaggtgctgaatatgtaattctgggtcactcggaacgtcgtgcttactatcacgaaactgtggaaatcctggaagaaaaagttaaattggctttggctaataacttgaagcctatcttctgcatcggtgaggtattggaagagcgtgaagctaacaaacaaaatgaagtagttgctgctcagttggcatcggtattctctttgtctgccgaagattttagtaagattatcttggcttacgaaccggtttgggctattggtacaggtaagactgctactgctgaacaggctcaggaaatccacgcgtttatccgttctttgattgccgacaagtatggtaaagaagttgctgataatacttcaatcctttatggtggaagctgcaagccttctaatgctaaagaattgtttgctaaccctgacgtagacggtggcttgattggtggtgctgctttgaaagttgttgacttcaaaggtattatcgatgcattcaaataattaatttcatcacagattactcaagcttacacagataaagaatcataaaatcgtctgtggaaatctgagtaatctgtgatgatttacttaaattcataaaacgacatgagatacatttttatcctactctttttgagtctcggactttccgctttggcacagcagaacatagtagaaagcttgcagcgtaaccgtgccggagaaggtactgtaaccatccgtcaagatcctaaaataacaggcttgattggtagtatctatacaggaaatgttacgggaggtgagcagaaaatgttgaaagccagagggtatcgggttcaggtctatgcaggaaacaattcgcgggtggctcgtaatgaagctaataatgtggctgccaaggtgaaagaggagtttcccgatatgcctgtctatgcctatttccagcctcctcgttggctgtgtcgtgtaggtgatttccgcagtattgaggaagcggatgccgccatgcgccgtctgaaggctaccggtgtttttaaagaagtatctattgttcgtgaacaaattaatattcccctggactaataacatggaagaactattgcatcccgaatggtcagcagagaaaattgaacagttgaaaggccattatcagagtattttatccctattgggtgaagatgtagaaagagaaggattgctgaaaactcctgagcgcgtagccaaagctatgctgacattgacacgcggttatgaacaagatccgcatgccattttgttgggagctaaattcaaagaagagtatagtcagatggttatcgtgaaagatattgatttcttctctttgtgcgaacaccatatgcttccgttttatggaaaggcacatgttgcttatattcccaatggttatatcaccggtttgagtaagattgcccgggtagtggatgtgttttctcatcggttgcaggtacaggaacgtatgacactgcaaataaaagaatgtattcaggaaaccttgaatccgctgggagtgatggtagtggtcgaagccaagcacatgtgcatgcagatgcgcggggtggagaaacaaaatgccattactactacttctgatttcactggtgcgtttaaccaggctaaaacacgtgaggaatttatgaatttgatacggcataaccgataaggagttatgcctttattttagtactacccggtcgccggcacgcttggccataattttttgtaattcacttaattctttaaagtgggccataacttcaaggcatttatcggcattggctactacttcaggtttgttcaatgcttgcagcgtatatttcatatcctcttctaatatggcaagtttgaagtcgataagttggtgcggtaccaattcgtgtaagcgttcttcatctttaaccatcgcttgtgaattgcttttactcagttggtaacgatcatttatcatatctgccgccagtttgctgattgtaggatcgggatgagccagaaaataacgctctgccgtgaagttggggtcatgcagatgagcttctgcttctgccagtattttccggtgcaacggattatggaactgtaattcatcctgtttcaaatccatagaaatatattctatcacagtaagaggagtttccgtattttcttccgtttctacatagcacatgactttctctccgtggcgtatcaaagtttgaagcagtaactgctcttttacataaaaaacgtacttttcccgtccttcttggggaatatacgattgatatcccgcttctgcttctgcaggaggaaacggagggggaacattatcatccacgcctagggtgggcatatcggcaggaggtatgctgccggcaggaaaaggagtatccgctggaggcagagagccggtagtggcggatgcgtctttttctttcttgatttgttccagatagttatcatcccgttgaagcagatgctttttgatctcgtctaaaataatttgctcgtttacgttcaagagggtagcacattctgtcaagcaggtatatcgaattactttatccggaatcagtccgatacttcgtgccatgtccgatatcaatccggcccgtttgatggggtccctttgtgcgtcttttagtaaaaggttggtcttgaaacggataaagttctcttcgtgatcatcaatgtattttctgaattccgtggcattgtgttttctggaaaaactatcgggatcatctccgtcaggcagaagcagcactttgatattcatgccttctgcaagtaacatatcgatgcctcggatacttgcttttataccggcttcgtcaccatcatataataaggtgatattggaggtgaagcggtgtagcaaccggatttgttgttcgctcaatgctgtacccgagttggccaccacattctccagcccgcactggtgcatggcaattacatcggtgtatccttctaccatgtaaacacagtcggcttttacaatggcagctttagcctgataaatgccatatagttcttttcgtttactgaagatttcggattcgggcgaattgacgtatttttggtttactcccttggtacggctgtccagtacacgtccgccgaagccaagcacttttccgctgatgttaaaccatggaaatatcacacgtccccaaaaacggtcgcgtaaactgccatcttctttttcgtagcatagtccggtcttgagcaaaaattcttttttatatccttttcgcatggcttcttgtgccaatgcgtcaggagcggtagtgctgtatcccaattggaatttcttgacaatatcgtcacggatgccccgttggcggaaataagacatggcaatggcttttccgtcagcgtgattgtagaggatattttgaaaataatcgcgggcaaactcattgacaacaaagagactttcccgtatattttgtacttgtttctcctcatcggtcaattcgcgttcctttatttctatattgtatttctttgccagccagcgtagtgcttcgggataggtcatctgctcgtgttccataacgaaatggacagcatttccacctttgccacaggcgaagcatttgcataatcctttggccggtgatacatagaatgaaggggttttgtcatcatggaatggacaaagtccgacaaaattcacaccgcgtttccgcagagtgacaaactcggataccacatctacaatttgtgcggcatccagtatccggtctatggtgggttggtctatcattgcgagtgcgaagatacaaaaaaaacatcgccaagggtgaacccggcgatgtttttaacggaatattgtaatcagaattatttaatataaggattcagtttgttccattcggaaactggaggaagtactcccatagcaatcacttcatcacgcaaagcacaaaggtgtgcataacttttttctaatgcggcttcttcttcgggcgtgcctttcacttcttttaagtggcagccatccttggtgatggaagtttcccaggccatcatgatatggtcgaacttaccattggatacgtaagttcctgcaggccagcggaatggttttcctcccatagcggcggcaatcatttcgatagaaacataggacgggctttggaaagaagagcggccgcgcaggttgatgatgtttgcaccgcctttagttactttttgttgtatttcggtccattgttcttttgtcaaagcatcagtgccgatgatatcaagtaatgcttttccgtttactttagcggtagaagcataaacagccatctgctcaccatgaccgccatacgtgcggcagttttctacgttatccatagcgatgccgaaatgcttggacaattcgctgcgcaagcgtgtagagtcaagagcggcaagggttgtaacttgtgatggtttcaaacctgaatataataaggtgatcagaccggtgatatcagccggattgaaaataaccacgatatgttttacgtccggacagtaggcctttacattttttccgaattcttcagcgatggctgcgtttcctttcagcaagtcttcacgggtcatgccggctttacgtgccgcaccacctgagtttacaatatatttagcatcggtcaaagcttccttgatatcggaagtgaatgtgatgttcatgccttcgaaaccgcaatggtatagttcttctgccacaccttccagaccgggagcgtatgggtcatacaaacaaatattgggagtaagacccatcatgatagcagtttgagccatgttcgatccaatcattccggcagcgcctacgattgtcagcttttcattcgttacaaattccataattctattatttaaagtttgtataatataaacacttttgtgggagaggatgttctctcttccgggtacaaatttacaaaaccttttattatggtgtttattctaaaaaattatatgggataatagaaagttatcccatataatcatcttgggatggtaagttccagaatacttgtcaatcaagatgttaaacagtatttattcaaacaggtttgtggatgtgacaaataatgatatgatttgttatgtattgatgtttatatagctttttaatgcgtctacatattcttcaaaggcttcaagcccttttagtgtaatcttacaaatggtacaaggcatttttcccttgaaagtcttgatgacttctacatagccagccttgttcagcttgtctatttgcacactcagattacctgccgtcgctcctgtctgttgtttcagatagctgaactcggcctcttccactgaaaccagtatggacatcacggcaagtctcagttcggaatgtagtaatggattcaattctttgaacataggcgcaaagttacgattttttttgtttacgggcagcatgattcaatacatgtcccggaataaccatcatgaaaataaagacaggagcgaagattaatatctggtttggacctggataaaaaaggcatccgatggagcttaacgctcccagtgtgccgcaaatagtgacagttttataacctaccaccagtcctgttagtgtagtccccatgcccatcagcagaaggattatgaacaggatgggaagttgccagaaaaacatggcgagcatggatatcagaaagccggttatgccgaataccaaccaaatataattgattactttgtccaaatgagtcttgatacccggctgctgattacgtgtagagaggtaagttcctgttcctgcgatgatagggagtaagaaccataggtattgccaataataatttctggtagttactaccagaaaccagatcagcaggctgacaaagagggtggtatatccccaaaagaggaatggcatgccacaattggtttctagcctgttttttgtattctgaatcatttgagcgatgagttccaaactctctttctcattcaattttctttcttccatactgttttttctttttagtttgtgattgattaatatttgatgcttttttctatggctgtcatcagcaagctgattccccagcctgctatcacccatagtacccaccagtagtgtggactggtaaaccagtttatagctataagaaacaggtttattaccacataatagactaatgaccaagtgagccaattccaaaaatgacgggcactttgccggcatgctgcttcgatttgttcctgggttggaactgtcttttcgttgttttggtttgttttcataggctttatttcttacttatggtgatataaagttagtggtctgtgctatactttcagtagcaaatctcggaatagctagtgtggcacatgccaggatagtggcacgcttcttgtaaaatattgtgtttgttttcattgttatgatgctttataggttgaatgacaaaagtttattttacttaaatactttacaaatgtaatatagtttataatataaaccaaattattatagaacttttttcaaataataattatcaagtgtgtatgtgcggtagagggggaggtgcaaaatatgtagtcttctttatgaattttacattcagactctggttggcacgtacttgaataaggacattcttctctgctttttctttcctggagtttttcagcagtggcaatagcttttgaaaactcacttgtgtgtgttgtgtatatcgtactgcgtttttcgtagctgttttcctgtccattccttgccctgccctagcttgcggtgtccggttgtccttcggatttgcttcttttccgtctttccttgttttccgtctgctgttttcgtatgggccccttccttttttccgtccttatacgcgcgtgcgaatattataatgtgtgtgtctttttcctccggtgtcctccgttataaaaacatgctttgtaacacatctgtagccgccgttttgattgaagcctccggacttgaagaagttccggaggctttttttgtatacgcacgcatgtggggagtctagtaacggaaataatcctatgttctgtaacatgaatatggtatatttttctctttttgcagtacttttagtgtaaattctatcattaaattctttttctatcattgatttttgtacttttgggctattctttttgaatttattgaagaaagaaagtgttaaactcaaaaaaatatcttctaagaatatggaaaataaaattcaggagcttaccgataagatttatcgtgaaggtgtggaaaaaggaaatgaagaagcacagcgacttatcagtagtgctcgcgatgaagcagcaaagattgtagaggatgcccgtaaggaagctgagtctattctcgctgtagctcggaagtcagccaaggaaactgccgaaaatacacaatcagaaattaaattgtttgccggacaagcagtaaatgcattgaagaccgaaatagctaccttgttgaccaatgaggtagtcagtgaaagtgtgaaaggatttgtggcagataaggagtatctgaataagtttatagtttcattagctgcccaatggtctgctaacgaatctatcgtgatctctaccgcagatgccgaaggacttaagaaatattttgcagcgaacgcaaaagctttgttggataaaggagtgagaatagaagaagtgaacggaacgaaatcactttttactatctcaccagctgacggctcttacaaagtgaacttcggtgaagaggaatttgaaaattatttcaaggatttccttcgtcctcaattagtagaaatgttgttttaaaacgggactatgacaaattattattgcctggtagccggtttgccggatctttcgttggaggatggcaaactgaactatacagtggctaattttaaatcggaaatctattcggaattatcggaaaaggataggaagttaatcgacttgttctatttgaaattcgataatgctaacctgttgaaactgttgaaagataaggaagctacgacagattttgaggggaattattctcagaatgagttgctggcgcttatcagttcggtgcgtgaaggcgatgctccggataagagatacccatcttatctttatgaatttattactgcttatttggctctttccgcagaggaactctatcgtgcggaagatatgttatctgcctgctattatgcgtatgccatgaactgcggtaatcaatttgtttcctcctggtttgaatttaatttgaatatcaataatatactggctgccttagctgcacgtaaatataaaatggacgtatctcaggtagtagtgggcaagacggatgtgagtgagatgattcgtacatcgaatgcccgagatttcggtttgtccgagatgctggaatattttgagcaggtactccgtatcagcgagattgaagaattagtggaaagggaaaagaagatagatttgttgaaatggaactggatggaagacgctgtctttttcaactattttactgtggagcggattttcgtgtttttgttgaaactggaaatgattggccgttggatttctatggataaggaaaagggaagcgaactgttccgtcagattattgataaattaaaggacgagatacagattcccgcagaattcagataataaacagattaaagatatatggcaacaaaaggaactgttagtggcgtaatagccaacatggttactcttaccgttgacggaccggtggcacagaatgagatttgttacattctgactggcggagaccgcttgatggcagaggttattaaggtggtaggcagcaatgtttatgtgcaggtgtttgaaagtacacgtggattgaaagttggtgctgaagccgaatttacgggacacatgcttgaagtgactctaggtccgggtatgttgtctaaaaattatgatggtctgcaaaacgaccttgataaaatggatggagtgttcctgaaacgcggacaatacacctatccattggataaagaaagagtgtggcattttgtaccgttggtgaaagtgggtgatgaagttggtccatcggcttggttgggacaggtggatgagaacttccagccactgaaaattatggtaccatttcagttgacaggtacttataaagtgaaatccattgttcctgaaggtgattatactattgaggatactgtagtggttctgacggacagagaaggtaaagatattccggtaaacatgattcagaagtggccggtaaagaaggctatgactaattataaggaaaagccgcgtccttataaattattggaaaccggtgtccgtgttattgatacggtcaaccccattgtagaagggggaacgggatttattcccggtccgtttggtacagggaaaacagtgcttcagcatgccatctccaagcaggcggaagcggatatcgtaattatcgctgcttgtggtgaacgtgcgaatgaggtggtggaaatctttacggagttccccgaactggtagatccgcatacaggacgtaagctgatggaacgtactatcattattgccaatacctcgaacatgccggtggctgcccgtgaagcgtctgtgtacacggctatgaccatttctgagtattatcgtgctatgggattgaaagtcttactgatggcagattctacttcccgttgggcgcaggccttgcgtgagatgtccaaccgtatggaagaattgcctggtccggatgcattcccgatggatatctcggctattatctccaacttttacggacgtgcgggatatgtacatctgaataatggtgagaccggttctattacctttatcggtactgtatctccggcaggtggtaacttgaaggaacctgtaacggagaatactaaaaaggtggcccgttgcttttatgccttggagcaggaacgtgccgacaggaagcgttatccggctgtgaacccgattgactcttattcaaaatatctggaatatccggaatttgaggaatatatcgccaaacgtattaatggtgaatggattggtaaggtgaacgaaatcaaaacaagattgttgcgtggtaaggaaattgctgaacagattaatattttgggtgatgatggcgtacctgtagaatatcatgtaatcttttggaaatcagagttgattgattttgtgattctgcaacaggatgcttttgatgaagtggattcagtgactccgatggaacgtcaggaggagatcttgaatatggtaatcgacatctgtcatacggaattcaagtttgatactttcattgaggtgatggattatttcaaaaagatgatcaacctttgcaaacagatgaactatgctaaatataaatctgagcagtatgaggattttaagaagcagttacaggaattggttgccgagagaagtgtctgattttaatttttaattttaatttataatgagtagagatggcaacaaaagcatttcaaaagatatatactaagattagccagattaccaaggcaacctgttcgctgaaagcgtcaggagtgggctatgatgagttggcaatggttaatgggaaattagcccaggtggtaaaaatcatgggtgatgaagtgactttgcaggtgttcgagggtacggaaggtattccgaccaatgctgaggtcgtattcttgggcaagtcgcctacactgaaagtgagcgaccagttggctggacgtttcttcaacgcttttggtgatccgattgatgggggaccggaaattgagggacaggaagtgcctatcggcggtccgtctgtgaatccggttcgccgtaaacagccgtcggaactgattgcgaccggtattgccggtatcgatttgaacaatacgttggtatcaggacagaagattcctttttttgctgaccctgaccagccgttcaatcaagtgatggccaatgtggcattgcgtgccgaaaccgataagattatcttgggcggtatgggtatgactaatgacgactacctgtattttaagaatgtattttctaatgccggtgcgctcgaccgtattatcagtttcgtgaatactacggaaaatcctccggtagaacgtctgttgattccggatatggcgctgacggctgctgaatattttgcagtggaacataatcagaaagtattggtgttgctgactgatatgaccagttatgctgatgcgttagctattgtgtctaaccgtatggatcagattccttccaaggactctatgccgggatctctttattcggatttggcgaagatttatgaaaaagcggtacaattccccgcaggtggttcaatcactattattgcggtaactaccttgagtggcggtgatattacgcacgctgttcctgataatacgggttatatcactgaaggtcagctgttcctgcgtcgcgatagtgatatcggtaaggttatcgtggacccgttccgttcgttgtctcgtttgaaacagttggtgagtggtaagaaaacccgtaaggatcatcctcaggtgatgaatgctgctgtacgtttgtatgctgatgccgccaatgccaagactaagatggaaaatggttttgacttgactaattatgatgaacgtactttggcatttgctaaagattacgctaatcagttactcgccattgatgtgaatctggatactactgaaatgctggatgttacatggggattgttcagcaaatactttaagccggaagaagtcaatataaagaaagaattggttgaccagcattggaaaaaacaataaattaacgaagaaacatggcaataaagtttcaatataacaagacctcgctacaacagcttgagaagcagctcaaggtccgtgtgcgtacgcttcctattattaaaaataaggaaagcgctctccgcatggaagtaaagagatgcaagacagaagctgccgggttggaggaaaggcttgaaaaacagattcaggcatatgaggccatgttcgcactttggaatgaatttgatgcttcattaataaaagtgagtgatgttcatttgggtataaagaagattgccggtgtacgagttcccttgttggaaaacgtagactttgacatccgtccctacagtctgttcaacagcccgaagtggtattccgatggaatatatttgttgaaaggattggcacagactgctattgaaagggaatttatgcttgccaaactgaacctgctggaacatgcgcgtaaaaagaccactcaaaaagtgaatctttttgagaaagtgcagatacccggatatcaggacgctctgcgaaagataaaacgatttatggaggatgaagagaatttgtccaaatcatcgcagaagattctgaaatctattcaagagaaaagaaaggaggcggaggcatgattacaaaaatgaagaagttgactttccttatttatcataaggactatgaatgtttcctgcaaaatatccgtgatttgggcgtagtccacgtggcggaaaaagcgcaggggacagcggagaataccgaacttcaagagagcatccgtctgtccgaccactatgcttcaactattaagtttttgcaaggttttaatgttgaactgcaagaacagaagggggatacagcccgtggagagaaagcgttggaggaagtggaggcgttacaactggagaaaacccagttgcagcatcagttgcagatttgcgacaaagagcgtgccgcgttagaggtatggggagatttcgatcctgcgtcggttatgcggttgcaagaagttggatatcaggtgaatttctatatttgctcagagaagaactttaacgaggaatggttggatacgtactatgctacggaggttaaccgtattggttcacgcatttatttcattaccataaccaaagaaggaacgttgcccgaattggaagtggaatcggtcaaattgccggtaatggccttgagtaggcttgctgccagatgtgaagatttggaacagcaaatgaagagtgtggatgataagttagctgccatagcaggagaaaaacttctttctttgcaagttgcacaagctaatatccgctcacagatagaattctcaaaagtggtgctaagtactgaacaagctgcggatgacaaattgatgttgttacaggggtgggcaccggctacgcagattccggagattactaattttctgaatcaacaggaggcgtactttgaaattgctgaccctacgccggaggacaatgtacctattcagttgaataataaaggattcttccgtctgtttgaaccgattatgaaactgtatatgcttcctaagtataatgaactggatttgacgccgttctttgctcctttctttatgctctttttcgggctgtgtttgggcgattcgggctatggtctgttcatggtattaggagtaactgtttatcgtatgttggcgaagaatgtcggtgcttccatgaagcccatcttaactttggtgcagattttgggtgcttctactttcttctgcggtatgctgacaggtacttttttcggatttaatctgtatggtaatgatattccgttctttaataagatgcgtgatttgttcttcttggacaatcaatggatgtttaatctttcattgattttgggagcggtacagattattttcggtatgatactgaaagcggctaatcagaccattcagttcggattgaaatatgcattgtcaactatcggatggattattgtattggtaagtacagctttggcattcctattgggagataccatgccgatgggaggaactgtccatttggtaattctggggcttgccggtgtgctgattttcttgctcaacagtccaggaaagaatatttttctcaatatcggtttggggttgtgggattcctacaatatggcaaccggtttgctgggggatatcctttcgtatgtgcgtttgtttgctttaggtctgtcgggtggtattcttgccagcgtattcaatagtctggcggctggaatgagtcctgataatgcagttgcaggtccgatagtgatggtattgattttcttgataggtcattctatcaacatgtttatgaatatattgggagcgatggttcatccgatgcgtctgactttcgtggagttttttaagaattcgggttacgaaggagggggtaaggagtacaagcctttcaagaattgaagaatgagaataaagaattaaaagctgtttaagccttttcggcattgtcattttgaataaatgttgtatccttgtgcagacagaaaagctagaaagggagaatctgaagcatagtatgcagatatttcgctaagttctggatgacatgaaaagtattccttttaggagaagtttgataaaataaagaatttaaaaattaaaaatagaagaattatggaaatgaatttattgattgcttatgtaggtattgcaattatggttggtttatcaggtatcggtagtgcgtatggtgtaactatcgcaggtaatgcatctatcggtgcattgaagaagaatgatagtgcattcggtaacttcttggtgttgactgcacttcccggtacacagggactgtatggttttgccggttatttcatgttccagagtattttcggtgttctgactccggctattacaggtattcaagctgctgccgtgttgggttccggtattgctttgggacttgtagctcttttctccgctatccgtcaggggcaggtttgtgctaatggtattgctgccattggccaaggacataatgtatttggtaatacattgattttggccgtttttcctgaattgtatgctattgttgctttggctgcaaccttcttgatgggatctgcattggctgcgtaatcagattagtttttttatatgggcggttatttcctgtttttatggaaatagccgcttttcttattctaatgtaaggcagaaccttaaaaatatttattattgtagccgatatcagtatttttttgtgaagattgttagagtaaaataattgaatgctaattcagaaactatctgaataacataaagttgcaaaaaaactttattatctcattgaaaatatgtaactttgcgctcgaattaagattagttaatagatggcaaaagaattgttagcccctgattatatattcgaagcaagttgggaggtatgtaataaagtagggggaatttatacggtgttgtccaccagggccaaaacactgcaggaagcattcaaagacaaagtctttttcataggacccgatttttgggcaggaaaggaaaatcctttgttcagtgaaaatgaaaatctttgtgcggcatggcgtgaacatgctttgaagaaagacggattgaaagttcgtgtgggacgctggaatattccgggagagcctattgtcatattggtggatttttatccttttttctctaaaagaaatgaaatatatggccggatgtgggaggattttaaagttgattcacttcatgcttatggagattacgacgaagcgtctatgttttcttatgcagccggaaaagtggttgaaagcttttatcgtttcaatctgaccgaaaatgataaggtcatttatcaggcacatgaatggatgacaggtatgggggccctttatttgcagaaagcggtacccgaaatagctaccatttttactactcacgctacttctataggccggtctatcgccggaaacaataaacccctttacgattacttatttgcttataatggcgaccaaatggcgcgtgaactcaatatggaggcaaagcattctattgagaagcagactgcgcatcatgtggattgctttactacggtcagtgagattaccaacaacgaatgcaaggagttgttggacaagccggcagatgtggtgttgatgaatgggtttgaggatgactttgttccgcaaggtcgtacatttgccgccaagcgtaagaaagctcgtgctgcgatgttgaatttggctaataaattgcttggcttgacgatgagcgatgatactcttattgtgggtacaagcggtcgttatgagtttaaaaataaaggtatcaatgtctatttggagtccttgaaccgattgacccgtgataaaaatttgaaaaaagaggtgctggcatttattaatgtaccaggttgggtaggggatcctcgtgaggatttggtggaacgtttgaaaagcaaagagaatttcacaactccgttggagtgtccgtttatcacacattggttgcataatatgagtcatgatcaggtacttgatatgatgaagtatttgggaatgtccaattcggcggaatctaaggtaaaagtaatatttgtaccttgttatctggatggaaaggatggtatcttgaatttggaatattatgatttggtgttggggaatgacttgagtgtttatccttcctattatgaaccttgggggtatacacctttggaaagtgtagcattccatgtacctactataacaactgatctggccggatttggtttgtgggtaaactcgttgaagggtagatacagtgagttgaaagatggtgtgaaagttatccatcgctcggattacaactattctgaagtggcggatgttataaaggacactatatcggaattttcgggattgccggaaaatacaatcaagacagtgcgtaaaaatgcggcggacattgctgaaaaggcattgtggaagcattttatcaaatattattatgaagcttatgatgtggcattgcataatgcacagaaaaggcttgttatgaatagctaattaattattaataaataatttgagagacatgaaaatcaaagtaagtaatgcgaatactcctaattggaaggaagttacagtaaaatcacacattcccgaagaactgaagaagttggaggaaatggctcgtaacatctggtgggcatggaattacgaagcaacagacctgtttagagatttagatcctgcaacttggaaagaagtggggcagaatcccgttgctttattggaacgtttgagctatgaaaagctggaggcattaactcaggataaggtgattgtaaagcgcatgaatgatgtatatgctaaattcaaagcttatgtagatgctaagccggatagcaaacgtccttctgttgcttatttctgtatggagtatggtttgacacatgttttgaaaatctattccggtgggctgggtattttggccggtgactacttgaaagaagcatcagacagtaatgtagatatgtgtggtgttggcttcttgtatcgttatgggtattttagccaaagcctttcaatggatggtcagcagattgctaactatgaatcacagaatttcggtagcctgcctattgaacgtgtaatggatgaaaacggacagccgatggtagttgatgttccttatttgaactatttcgttcatgcatacgtatggaaggtaaatgtaggacgtgttcctttgtatctgctagatacggataatgaaatgaacagcgaatttgatcgtcctatcacttatcagttgtatggtggagattgggagaaccgtttgaaacaagaaatcttgttaggtatcggtggtgtgttgctgctgaagaaattgggcattaagaaagatgtctatcattgtaatgaaggacatgctgctttgtgtaatgtgcagcgtttgtgtgattatgtagaaagcgggctgacatttgaccaggctttggaagtagttcgttcttcttctttatatacggttcatactccggttcctgcggggcatgactattttgatgaaggcttgtttggaaaatatatgggtggttatccacagcgtatggggatttcttggcaggatttgatggacttgggtcgtattaatccgggtgatgcaggcgaacgtttttgtatgtctacatttgcttgtaacacttgtcaggaagtaaacggtgtgagctggttgcatggcaaggtttctcaggagatgttctctggaatttggaaaggctatttccctgaagaaagtcatgtaggttatgtaactaatggtgttcatttcccaacgtggagtgctactgaatggaagaagctatatgctaagcattttgctcctaatttcctggaagatcagtctaatgagaaaatttgggaagctatttataatgtagccgatgaagaaatttgggaaacccgtatggctttgaagtacaaattggttgaccatattcgtaagcagttcagtgaaagctggttgaagaaccaaggtgatccttcacgtatcgtttctctgatggaaaagattaatccgaatgccttgttgattggttttgcccgtcgttttgctacttacaaacgtgcgcatctgctgtttactgatttggaacgtttgtctaagattgtgaacaatcctgattatccggtacagttcttatttgcaggtaaggctcatccacacgatggtgcaggtcaggggttgatcaagaagattgtggaaatttcccgtcgtccggaattcttgggcaaaatcatcttcctggaaaattatgatatgcagttggcacggcgtctggtctcaggtgttgatatttggatgaatactcctacccgtcctttggaagcttctggaacatcaggcgagaaggctttgatgaatggtgttgttaacttctctgtgcttgacggttggtggctggaaggttaccgtgaaggagcaggatgggcgttaactgaaaaacgtacttatcagaatcaagatcatcaagatcaattggatgctgcaactatttatagtattttggaaaatgagattcttccattgtattatgcacgtaaccgtaagggatattctgagggttgggtgaagactatcaagaattctattgctcaggtggctcctcattatacaatgaaacgtcagttagacgattattatgctaagttctatactaaagaagcaaaacgttttaaagaattggtagccaatgattatgcaaaggctaaggaactggctgcttggaaagaaagagttgcagaactttgggattccattgaaatcgtttcatgtgaaaagacggaagagctggctagcggtaatattgaaagcggaaaagaatatatcattacttatgtcatagatgaaaagggattggatgatgcagtaggtattgaactggttaccactttcacgaatgcggaaggtaaagagcatatctattctgtagaaccaatggaagtaattaagaaagaaggtaacttgtatacattccaggttaaacacagtttgtctaactcaggcagcttcaaggtggcataccgtatgttcccgaagaatgttgatttgcctcatcgtcaggacttctgctatgttcgttggtttaactaatcattgaattaagataatatttctatttaaagaactgtttccttggaaaagagaggaagcagttcttttttattagtatgttcgcccaaagtttcattgatattatcattccagttaagattgttatggaaagtgtgcattattgggaaggataggacgagtataaaaaatggaggtgtgtcgtaatgcacgatgcacctctttttttgttcatcactatacaaatctgttcattttctttaagctgcgatcttttgaagatttctttgatttatgtgttcccagcatctaaaaacagcagttgtaagctcataaaacagtctaattagccagttcatacccttttttgtcagttttgcacacatcttttttatattgaaggcaatggctaggaaggcaaagtccatgaagaccttgtcctttccaaaatgtcggaaacgtttgtagttcatattgtttttaatttgtccgaacacggcttccgattctatgcatctctgccctctgtgtttcagtcctttctcagagcagagcagttctttggctctccgcttgtattgtctaagcctatgattcagttctatcgtcctgtttccttttgctttaaaacagcggcatcgcaggggacagccttcacacctgacagctctgtaccgtgcattttcgttgacatatccggatgcggttttcacattcctggtgcctatcctccgcatcctttgccccatagggcagatgcagaagtcatgttcttcattgtagtagaagttttcggccttgaacgggtccggtttgaatctcggccgctgctccatgtggaaatagttgtactttacgtaggcttccatgccgttttcggacatgaagcggtaattctcttcggagccatagccggaatcagcaaccaccgtatgggccatccggtcatacctgtttgaaaaagattgcaggaaaggaatcagggtcagtgtatccgtagggttcgggaagagtgcaaaatcggtgatgaactgattttcggtgccgatttgaaggttgtaaccgggcttcgtctgtccgttgcgcatggcatcctccttcattctcatgaaagtagcgtcattgtccgttttggaataggaattcctctcttgcagcgtttccggatggcagtcgtattcctgtagtttgtccctgtgttcttccagttccttcaactgtttgcgtttctttttcagttcagtcttttcctctttcgcggatggctcggaaacctgttcgagtgcttgacgcaattctcctgccatttcagccagcatggccggagtgaacccaacctcctcattgttctctgatgacttctcccgggcaatgacatcgtctatctgccctaacaggacatgtatcttcttcatcaggcgttcacggttccgctcaaccgtttttcgccagacgaaagtgtacttgttggctttggattcgatctttgtcccgtcaatgtattccacattcaggctgatgaagcctttggaagagagaagaactacggtttgcgtaaacacctcgttgatttccttcttcacccggttgcggaaacggttgatggtaatgaaatctggtttctcatatccggccagccagatataatggatgtcacggtgaaggagcttttcaattttccggcaggagtagatgttgttcatataggcatacagaatgaccttgagcatcattctggggtggtaagggctgcgcccgcattccttatacagctttctgaaactttcaagattcaagccctcaaccagggcgtcaaccatgcgcaccggatcgttttctgcaatatcctcatcaattctttgaggaaaaagaacggtttggttgggattgtaaggacgaaaatgtatctttgtcatagtaaagaacttatgcttaaagatacaaagtctttaggtaataacaaagccccagcttgtgaaagtcggggctttgtgcgtaaaaaacagaaggtgtgcattttgacacaccttcgttctttatagagtaatagaaagaatatacatttaaagcataatctattcttctatgttatcgtttgttaacagtcatagcaactttaattattacatcgtgaccatacatatccttgcacttgatagtcaatgtagaaggaacagcagcagtcggattcgtttcagaagacaaagcagtagccttgaaacctgtaatatgcttattattatctataattacatcaaagtattcttcttcaccatttgcatcactggtcaaagtcgcatctgtaataatcagacttgattcataaggtgtacttaacagtttgctatatctgctatctttagcacttgttccaaaaatgaagctgtcagcagcaaagtcaagacgatctgtaccataagttaattttgtagacggcattgcagtggtataattaccgtcgttatccttatctgtatacggagcgcctaattgttcgcgagtagcccatgcccaagtataagtgctattataaatacagttgtagatagtttcaaatctttcagcttctctagttacatcatcataaccaccttcagaattcttcactgaagaaatcttaccatagttgtaaaccactgtagtggtatgtttaactgagttgttgatgtaatctttagcaacttctaatgttttgtctccggcaactactacagcaacatctttatttccatctttcttagatgtagcgaatgttatgttatagttagcggcagcacctgtaccatagttgaatacttcagacatcttcatagaaccctttgtagctgtttcagctgtccaagcgatatcattggcgtcattcataggaatcatgtaacaattatagatgccatcagtaacctgtgcagttttaacagagaatcccgcaggaatagtagtaggcaataccttagtcatagaaactttcatagtggctaatacatgtcctgaagcattcttgatagtcaatgttccattataagttttgttatcttcatacttggtccagtcatcaacagtcggaacagtataaactttggcaaccttgctgaaatctgccgggaatgtatttggagcagctgtattgtacagtacattattattagcatcaacaaagatagcattgaatgcaggatttacattattaaccttgtctgtagtccaagtagcagcagtcggagcagttaacttagtcaaagacacagcaaccttatctgactgagtgtcagtaacagctttgtcagtcggattaagtgcagtaacagtagtggcagtagcattccaatctgtagcagcattacctaactgcacataaaacgctttaccatcaggatcaactaaagtaccatcaaagtttacagcatatacacggaaaccaataacatcattaatagccgtagtgctgttgatggtaatttctgtagaagtaccttcaaccactgtattcaaaccagaataagtatagctattccatgcattcaattcagacggtgcagattctaccgcattagccttatctaaaactacataaataccacggatatttaccggagctgttactttatcatcggctgtagacaaagcaattttgatagcctctccttgtactgcaggatataatttttgagtttgacggtcgtctccgttatctactttaacatttgtattaaccttatctaaaggaataatggtagtagccgcatcactcttccaagctaattcttgatatgttacattagtaccatcttctgctttagtgaaacgattatgaatatccttgacgtttgttgcatcaacaaaatagtttaaagacttttcacctacatattcagtccaatccaaagttaagtcataagatgaaataacttctcttgtttcagcagtagacaaggtgttatttacctgtacagcaaagagaatagattcagtatcattgccaactttggtttctgttacagcagaaaaagctttttcatcataattcttcaaagcaactgtaacttcccacaatccgttgtttcctgccgcacggcttaataatccattatatttctcaactttctgaacagataaaaattcattcaagttctgtccttggctattagtcaaagaaatcatatcaggagtaagaaccgcatttgtcggagatacacgtactacaaacttgtcaccagtctgaacttgtttacccttagtaaatgttatagcatttgtaataccttcactaaatacgttttctttttcaatagcagtggagaaaatcaattcatcgcctgtaggattagcagaatacgaagccaccagttctacactagtaaccatatcagcaatcttgcctacaatgtcttctactttcttagtggcagcatcaactttttctgccatttctttcaatgctgcgtcagtggattcttctacttcttttttcaatgtctcaatttctgcttgtacagctttgattgcttctgcctttgcatctgcaacagccttgtctgcagcggcttttgcagcagcggcagcatcaccagcagcttttgcagcggtttcagcggcagttgctttagcaagagcatcgcttgcatcttttgcagcagtagttaaagcagcttgcaaagtagcgatctgagaagtcatgtcctccttagtcgccagtttgttaatttgttcctgcaaattgtctatgtcatcatcatagtctttacaagatacaaatgttcctgtcgaagaaaccatcaaggctccgaacaggattgcacttaaaaattttttgttcataatagaaaaactttaaatttataaatttaaaaactcaaaatgttccggtaggtttccgccagggcatgatgcgcctcgtcaatgacgatcaaatccggccgtccgtccataatcttccggtttcgtgacaaccactggatggaaaataccctcaccctcccggattcttccggcatactgtctttccccgtccttccgttctttgccgacttgtccggttcttttcccattccataccgggctacggtttcctctatctgctccaccagctccctgcggtgtgccactatccacacccgcataccgacaccgccaccacagagaaactctttcaccaccgcagccagcagatgtgtctttcccgtgcctgtaggcatttgtaccatcacactccggtgaagctcccactcttcaaagaggcggagcttcatctcctgctggtagtcacggagaccgtcgtttcttgccatacatcatcccttatttcagatgtatcctgaataccatccctgcactgggatacttacattgggtcagttccaccacaccactaatataatccttccaaaagttatacccgataccacaattcaccgaataactatcgtattccgctatcacattcagcccattcacagccttcatccaaaaagaggtagccggcagggcaaactgaaaattcacccccgccacaggtccgttccggtgataatccagacgcttgttatagacataaccgaagtgcatccccaactcccccacattcttcaccccgaagtgcttggtggcaactatgtaatagcggttccagtgtccgttacccaccgaagacgtacccgtaaaaccataatcgtccttattggggtcgcccagcacatcgttggtggaaggatcgttcgcccccaccacaatctgcggtgtccactccttccaccatccttccttccatacacgcagccgggcggaaaactggcggtcctgattgcggaacttatatgaataaccatactggggcaatcctattttgtgcagcgtacaggtatagcccacttccagccacggaaaaagggtgatgtttatgtagtaattccacgtgtcataattccaatgcttcggggtagccgccacttgcagataggaaaacccgcacagaaaagtcttgtcgcgctgcatatccgcgctgggggcgtgaagaagccccgtggtgccatatacatattgagcccgcgtatgctgcaaacctgctaccatcaataatgccgccgcacaaatcaacttctttatcatcatcagttttattcttatttcaacaaaccctcataaactcccatcacctgctttgcaatcttgtcccaatcatacggagccatgtcatactgcacactatgataatcctcgtctatcaccttctgcaatcgagcggcaagagcatccacatctccacaatgaaaatagcagtcagaagaaaggcctacctccagattggcaggaatattactcaccaccaccggcaagtgataactcatggcctccaataatgcaataggcaacccttcgtgcgatgaaggcaggcaataacagcgagcatttgtcagcaacgagtgcaacttatgtcctttcacgaatcctgtcagcaccacgcctgcctcttgcgccatctttttcaatcccagtgaatattcatcttcaaaatccgtatcgcccgccagcactaacttacaatctccagcttccaacttcttgaaagcttctatcaggtgatgcaggtttttctccggcacaaaacgacacatgccaaggatgtactttcctttctcaatacccagttcttcaaagtattcgggatagtcgcaaatttcaggcttcggcacaccattgtaaatcagatgtaccctctcacgccgatggtacttccgggcaatcagatcctgaattacttcagatatgacgattacatcatctgcaaacctgcaccccaaccgctcccccagtttcagcacacttttggcggcaaagccccacttgtcacggtcatagtcgggcccgtgatgcgtgaacaccaccttcatgccgagcatcttggcgtatggcactaacagcgcaggtccgatggcatggatatgcaccacatccgctcccagctttttcgccttgtttacagcccgaaacgtatggacaaccgcttcgtatgatttccttttcggtgcgctgatatccaccagcttcacccccttccactcggtgagagaatctctcacataatctttgcggcggatgagagtggtgtccacacctttggccgcaatgcggggaaatagttcctcgcaatgcgtctctacgccacccatgatatcggggataccacgggtgccggtaactactagtttcatcaaaattttagattattattaatgaaggctacaatccgaataggacagccacaatgcattcagcctcatttcctgatacaggaaatgaggagataagttttatcggtaaatattagttattaagaatccacgccaaatccctcaacaaccagacaaaggcaacttcgccccaattatttggctttctataaaaaattattcaattcttctacaagcctataaacagtagtagaagactcttgttgtgccggattattcccatcaaattgtttcatgatagttttagcgtgattaatggcttgttcttgtttaagaaataaagcattaaacattttagagcttacgcccgacttctttgtataagcaaatccgagcaaagtactcaacattttttcatatctggaacgatgcaaagccccctgatacagattgaagtgaagcaagaaccaaaattcaaaagcctggttgctataagccacttcaaaaccattctggcgagctgacaggattgcggagttaaagtcattttctggaaaatcatctttgtcaaagaccacccaattctgattgtatgtccttcatctttgcctttcctgctcttttatattgatagctttctgtactaatgctaatgtccccatgccttggccgatagctttcacagtggcagaagtcaagcggaaggcattaaagtagtctggttcagtattaaccccctcgcaaataatcagaaatgtttgtttcacttcacgcacaccactgatacgggttatctttctttcgatacgcggattcatatttttcctttttgtagccgccatagtttatttttcttgcgtattaaacaaacgggttaaatctccgacaattggaatagctccatactttccggacaggtaatctttttcaaacgaagcatcattacgaactttatactctgccaatgaataaagttcggttgctccataacggtctttttgtgtaaaccaaatctgatctcgtcggaatatattagcactcaacaagtttgtatcgtgggtagtgaaaatcaattgggcatttttcggatttgtttcttttgaattaaacaaggtaataattctacacgtaagaagtggatgcattttggaatcaaattcgtctataatcagacgcttcccattatccaaagcatcaataatgggatatgctaaagaaaaatactttattgtaccttccgattcatttttcctgaatgggaaggtaacagctttgacttcattaccttcatcatcgtattgtgtatgcatactgacaatagtattatctattttttcaatattttcaatacctaaatcagcataacgggaaaactccacaattcgctgtttcattctgatgtcatccagttggatggtggcagtattccatattttctcatcattagaacctgaaataatagtggtatcgttcaaccatttcatgatctccactgccgtcggatcattgaattgtgccgcaacagaaagtaatagtgcatttgctctcaccattcgtttacctgcaagctctttaccaacggcaaacttggtatgaatatcaaaactgtctttttcccggtagaataattccacctccttagcccttttcttattagctttttgatagagccattccgaatgtaccgatgaattgtcagcttcaaaaccataacgatattgattatcctcatcacagaatatggcttcaaaataacttggttcacctgctgtaagcgaatttaaccggaaactttctatattgacacgttcccctgcctgaatatccttcgatgaatttatcacataccacttgaagaactcaaatgctttaatgaaattggatttaccggatgcattggcaccgtaaacaaccgcactcttcattaacaataatccggcagtccctacactaaagattatatcttcagccggaacctgtatttctttcaaagccgatgccgctaatgacaatgtagactgttctttgaaagatagaaaatttcctattgtaaattgaataatcatactttaattgcttcattcgagattttatcacaaatatagcttttatttttcatataaggataactatcaagtgaattatattattttatgtctaataacatgcaacagttcctcgcaatgcgtctctacgccagccatgatatctgggataccacgggtgccggtaactactagtttcatcagaatttctcccttaaatcaccttgacaagagtcttgccctacatcgcaccatttcggttccagacaaatatctttcccttgcagtgatttcagtttattgattaacgcccatttcagcggatacttaatatatttgtgcattaccggcgaagccgtacccaccatccagcagtttttgggacaacggcgcaccatggcgcgaacctcctgtgcctgctcactctcccatatggtcataaagtcgggagtttcgtgaatattccccatcgacttcttccaatacttctcttccagcccattacaaggatatacatcaccaaacggatcaatgaagaagttagccgaaccggcctcacaaggcaacatacggcgaccgccttcaatataatttatcagtcccatattgaaccaggcacggaaccagctcttcggatgacgctccttcagctgccattcaatgagttgcttgaagtcaccacacacctcatttttattagtgattacattgtcttctttgtggaagtagtacgaattatgaaaagcagctgtggcgaactccatccccaagctcttgctcagttggtagagcgaaagcatgtctttagagttattgttagacaccgtgcagccgaaaccgatatccttcagtcccatttccttcaatgtcagcagtgtgcgaagtcccttgtcgaaacctcccgtatgaccgcgcagttcgtcgttcttgccactcagcccctcgatggaaatgcggatgccgatatttggaaactttttggccagcgccaccacacgatcctcaaaccatccgctggtcgaaatgacaatacggtcggtatgccggtagcattcctccacaatctccgccaaatcctcgcagacgaaaggttcgccacccgtcaggttgataaacttcaacttaggcagtgttctcaaatcactcgcttttatctcttcgcttttgttggtgggattaaaccagatgttgcacatcttgcacttcatgggacaacgataagtcaggatgatacttgcgtccgtaggagtaggaacagaataattgttatttgacatattatattatttttactttaaaatcaattatactctactttctttgagcggatttttgtccgactgataccattcaacaaatctggcgattccctcaggcaatctgaccgaaggacaatagcccacttcgcgctccaacttcgtagtatccgcattggtttgatacacatccccctgttgcatcggcataaaatttttctttgccataatacccagattcttctctatctcgctgataaaatccataagttttacaggatgactacacccgatattatacaccttggcaggtacacctttttctgaaatctccggctgatggtctatcacctgtatcgtaccgtttacaatgtcgtctacgtaagtaaagtctcggataaggtcgccattgttgaacacgttgatttcctttcccttgctgatggccgaagcaaaaagcatgggtgccatgtcgggacgcccccacggaccatatacggtgaaataacgcagtcctgtagttttcagcccatagagtttaccgtaggcgtgtgccatcagttcattacttttttttgtggcagcatagatgcttacgggctgaattacttcgtcatcctcgctgaacggtgccctgtcgttcagcccgtatatgctgctcgaactggcataaaccaaatgttgaatattatttaagcgacaacactccaatatattcataaatcccattacattgctttctatgtaggcataggggttgcgcaaactataacgtacacccgcctgtgccgccagattcattaccttgtcaaatttctcctcctgaaacagacgactcagcgcatcacggtttacgatgtccatacgcacaaagcggagattaggcatcaatgtactttgcagggcgcgtccccacggcatatcgggaaaggtcactgctgtccttccatcatttccggtttcgggaatcgcgcctaccatcccccattgcgcgtccgcctctatcccataaaactcacgcaagcgggcgtacttcaaattgggatcgtaatacgtattgatattgtctatgcccaccacctcgtcacctcgttttgcaagctgagaggcaagccgcgaaccgatgaagccggcggctccagttactaagattttcatttttgttttcctgttatgtcattgaatagcttcatcaaacgattatagtgctctgccggagaaaaacaagtctgtacgttttggaaggcattttcacccattgcctttgcttccgtcggatgggcaaaaaaataagcaatcttactgcgaaaatcttccacatcctgatagttgaaagtcaacccagtttcaccgtttctcaccaattcaggcaaagagccgaaattggtagccacaacagcttttttataggcaaaactttcaagaattacattcgggaaattatcataccattccgaaggaacaactgtgcacaggcaactcttcaggtaaggcacaatctgctcaaaattcattttacccaagaactcaatatgatgccgcttgccgttcaaatacgcctttaactcatcctcataaccatcgtttgaaaagcctataattttcagattatagtcggtattctgaaaagccttgaccagtgacatcagtcctttttgcttctctatccgcccaacaaagagaacaaaaggcttatattctacttgtggatttccctctttcaaattaaagaaagtgggaatgtgatgcaatttttgtcgagaaatgccatactccaccaattttcccaaggtgaaggaagatggcactacaaaagcatctatctttcgagtgatatgcatcgcatcgtgcagcatctttgctccgagttttatgacggaataaaccgtagagttcaagacacacttatttctcacgcagttccatctatttccgttcaggcactcctcacaaacacctttcacaccattgtagaacaatgcgttgggacacatatactgaaagtctgaaatgcggtgtatcacaggtattcccagattttttgccgcatcaatgatgctaggtgatatcttgttatgatattgcatgatatacaccaagtcgggatttgtgtcagtgagcagttgtctgaatttcctcttagcttcaaaagagtaaaacatacgtgaaaaggatttcagaatcactttcatgctcttcttattcgaatgagcaaaatacacttcatcatcgagcctgtccaagaaatacgtttcataatcacttgaaaaattccgtgaattcttcacgctaaaaggtatcactacatgcccgttacgttccagtatttcttttatattgaaataataacgttctgggcctccacttataaaataacggtaatttactaatattattttcatatctgattgttgttttttaattcatttccacactccccccctcattctctcctcacattatttatctgcgtacgaatattacccgtggacgtccccgacttgaacgtcaggaactgctggagcgcctctatgaaattcttgcttaccatacgttcggcagtaaggatggtatgcttatgcatatcattcaccacaaggttcgccaagtccgatgcactgcggcaatcagctatgcggcggatgatatcattcagttcccagtcatcagagtagtaaatgcacaacgtgccacgggcaatacgcactgcctcatcctcctctttctcttccataccattgttctgtgttctcacatgggcgaactcagcaccataaaaattttgcactacctctgtagcgttgggcagtatttgattgttaccgccatgaatgttgataacaacacttgccctcgcagtattttgagattctttagtctcgtttttcattatcgttttatcttgatttctaattattcccgattattttaaatcatagagtgattattttaaatcgctattgtcctcctgaaaatttactctgtactttgcagacacaaaattctacgctacacattatgaataaagatttttttaaatcaagcaacccatcgcgcttccactccctgcgcgacacccggcctgaacccaccacctggcaggttcttttcaaggagataaccaacagcacccacaccgccgccacccgtcattaccgcgcccatctggccacgctgtccgacatcgaggcgacaggcgacgcgcagcagctggagcagtggaagctcaccaaaagcaacatgaagaacgcacagccggcattcatcccctccgtcctgctggagggagggagaacctacgcccatgtcaagggattcacgggatttatcatggtggacatagacggcatcccccccgagcgattcgccgccatcctgactttggtaaaggaggatattcattcctttttggtgtacatcaccatctcgggatgcggcatccgggtcatcagccacgtggagggcggagtgaccaaggccaactaccgcatggtatgggagtgggtgaacgaccattacgctcgcctgtgcgaagtggagattgacggacaatgcaagaacgccacgcgcatgtcggtcctctgccacgaccccgaagccctgctccgccccgaagcctcctccttccacaccagcggaatgaagccccgcgagaagccgaagcgcggcactgccgtgaccgtgacggcagaacgtgcctacaagattatccgtgcacagttggaagaggaaggaatagcatacgcaccgggcagctacaacgactacgtaagccgttgtttctatcataccaaccgctacggtgttccgcaggcggacgccgaggtatgggccctccggacttttcccgattatccgcgcgagcagctgctgcccatcgtaaaaagttgttactcgctcacgatggagttcaacaccgtctccctgccccgttccgtccgaaaaaaggagaaagagaatgattcctctcataagaaggccaccgtggaggagatggaggagtttatcaacggctatatgaagttccggatgaacatgcttacccaccagattgagacacaactgattgctgatgcgtacaccgaccgtcccgaagcttccgcctgccactggcagcggctcaccgaccacatcgagaactccctgtggtgcgccatgcaacaccatggcatggcggtcaacctgaacgagctgcatacgctgctcggcagtgatttcgtcaaggaatatcatccgttgaaagagtatctggacggtctgccgccctgggacggagagaccgactacatcggccggctggccaccatggtgcatgtcaaggaaagtccgcacagtccgttgcagcaggacaaaagccgggaacggaacgacctctccgaaactcccgtccgctttgccgacatcctgaaacggtggatggtgtccatgattgccgccgccctggacgagaccgtggtgaaacaggtgatcctcaccctgatagggcggcaaggcagttacaagacctcgttcatgcagcatatcctgccgcccgtattgtccgaatattacaccacaaagagcaactctagccgcatgaccaaggacgacctgttcaccatgaccgagaacctggtgatcaatctggaggagatcgacaccatgcccccctcggagctgaaccagctgaaggcgatggtgacgcaacgctacgtggacgagcgccgagcctacggacgcaacaaggtgcacctgccccatgtagcctcgttcgtagccaccgggaacaacctccagttcctcaccgacgacacggggaaccggcgatggctgcccttcgaggtggaggacatagacagcccgtgggaggcggacatcccctacgagggcatctacagccagacgtacgcgcttgtaactcgtaactttgccgcatcactttttcgtaacattaaatatttcactttacgaaaactatatttatgtagaaaatggatgcaaaaaagattacagaagactaccacgactggcataacattgccgaacttcgacttcttggcttgagccgttctcaaatagcaaagaagctgcaacttcctcccggcagagtcatgcggctttcccgattaaatgttgatgagcttcttcaacatggcaatcgtccgcgcccttcttattcctgccgtctcgatccttatgaggagtcagttaagcatttgctgataacctgtccttattattcttccacccagattcatgaatatctaaaggagaataatccctcttttccaaaagtctgtgaaaagactgttttcaattacgtaaaaaaaatacgtaaaagatacgatatacctgcaagagtataattttttgcagcaacaatcttttgttcagaattcaataagaatctgaactgcatccttattaccgaaatttaaataaaagacattatgaaatccgttatttcagacaataagattattccattcctgccttgttataaaaggacatcacagttgcatgaaaccaaagttagtgatctgaaaactgtatatggatgtaatggatatgcggtttatgattatatagaaaatgagatattccgtacaggaaaccattcattgtattggtgtaagaatatgctttgcagagtagcggactattgggcactctctccggaagaagtggagaaaatcgtggagtattgtattcaggttgacttgttcaatgctgagttgtataccaagtatcatattcttacatccgcagaaatcaggcaacagtataataatgccggtttcttcatggctgtcaattcataatcactaatccgaaaatactatgttgataagatgtgaaatgttaaaaaaactggcaaacgcttttatagaggtagccaaagaggagaacctgcctgtaaatatcacaatgggcaggtcttatacagactccggcggttccagacaagttggtattattcttgaatttgacagttggaactcgaaaatcatcaatgataaattagctgacaccatcaacagaatcttcgaacttaaataatatataatagaaagggagcaatatggaaatattaacggccctgcaatgggctaaaaagggttttatccccaatgagggggccaaaggtacaaaacaatggactaacagcttttactctgccaaagctgtctatttcaaagacagtgaggtccatgaagataaggacactgccaaagccatcctttttgccaaaaggaaggagtaccgggatgtagccaagaaacggaaagagaaaagaataaaaaatgctgcataccgagagaaaatgaaaacccagtggcaatggttacaggagggaagaatacctaacgataatgccagatgggaagttggagaggagctgaataagatgttttgtacatgtgcttacggaagcaactactgttattgccatattgatgaaacacatatacccaaagatagtgaagagatgcaaaaagccatttttgatttttaacagaaataactgggtatgactataaacgatatagaaatgaagaagattaaagatttaacaatcaaggtaacttatagagttggacttagtgatgttgaagtccctgacaaagtttatgatgaattagctaaagcttatgatgaaggtgggtatgtacctgaaggggatgatgagcttgaaaatgcaaatgaatggttattagataatatccgacaagaggatgcaatggattgggagtttgagattgacgattttcaagatgaataattcaaaacggtatagagcgttgattctgctggtgtgataaacacgactaacactttcatcgaaaaagattaatatttaaaacgatataggtatgaatatagatactgaatttaacgtaggagatagcgtatgctatctgagcggggataacattatccatacaagtataagcaaaataactattgaaatatcctatgaggatgatagctttttgatggtttacaaactatctgacggtgtaagtgtgcccagaaacaattatccacaatggggaaaaagactttttagagataaggatagtttaatgagatatttatcagaatcgtaacggaacaatagactaacaggcaagtcaccgcattgtatgcaggctggtgatacaggttcgaatcctgtttgtttcacactgaaaaaaaaattcttaaaacgtataattatgggaagaattgccagaaaaggctttgagtactacagggccgaaacggaccggttccgtgacatcaagatccgcaagctgagaaaggaacacagctgtgccggttatgcgatataccagtatgtcctgaatgagatctaccgtgtggaaggctgttatatccgtttcacacaggacgagctgttcgattgtgcggaatactggaacatgagggaagaggaggttctccggatcatcaactattgtacggaaacggggctgttcaatgccggaatctggaaacagtacggcattctgacagggcactccatccagatccgatatgtgtccatgtgtcacgcggccaagcgcaagacagtcattccggaagaaataaatcttctttccgaagaaaaatcctccttcccggtttcccgggcacagctccctgtggaagcggcgtccgttccgatctgtggatctgtggcagtcacctctgttcccttcacggaaccttcagaagcgcccgttcctttgaaagagggaattcttccggaaaaaaccggatttattccggaagaatccgtgaatattccggaagcttacaatataaaggaaagaaaagaaaacatatcatcctcaagctcctttacatccgttcaggaaaagacggatgaggaggacaattccatccggactttaaaatccgatctggaatacctgaacctgaaggatgaccagatccgctgggcgtgcattctgaaagcccgttatccggccatgcctctggagtacgccatagccgccgtcaaggacagcatccgtaacggtgactaccgttacagtgtgggcggctgcctcactccgctgatagagaactatatccgcaagtacaacgctgaatgttcaggagaaaagaagcaggacggtttccgtgccgcccttgagcgtctaggcatttctccggcacagcagcatgagattctgcatctgtccgcagactccccccgtgtgctggaagccgccctgaaggaaatcgagcgcagcaacgggcgcatcaggagcccgctatgttttctcaggagcaggctgatgtccgtccggaccgcataatattttgacattagttagtatgtgaaagaacattccatcctgccgtcccgctgtgaagccggtgcggcaggaacttaaaaaaacgaaagattatgaaatcacaggaagccaatgcgatccccttgcgggagatactggaaaaatacggtcatgaaccggtcaggtcctaccacggctatctcatgtacagctcccctttcagaaatgaggagacccccagcttcatggtgaacctgcacacgaacaaatggaaggatttcggtgaggacagctcgggaggtgtggcagacctggtcatgcgtctggaacggtgcgattttcactccgccatgcggcggattgaaaaaagcgacctgtccgccccgtccgaccccctccttgttccgacttccgccggggatgccggcaccagccccagactgactgttgacaatatcaatcccctgaccaacaggatgcttctggaatacatgggccggcgtggaattgatgcggacattgcaaaggcatattgcaaggaagcatactaccatttcagcggaaggaaggacaggcgctgtttcgccgtagctttccccaatgacaagggaggcatggagctcaggaatccgatattcaagggatgtgccggaataaaagccgtcacctgtcttgacaatggaggcgaccgttgtgccgttttcgagggattcatggattttctcagctatctccagtatgccagggaacatcccggactgccgccaatgaatttctgcatcctgaactccacggccatggccggcaggtccggagagttcctttcccggcaccggctggtacatgcctttctggacaacgacaaggcaggcatggacgccctggacaaactggaggggaatcttgggaaggatacggtactggtcaatgagtccgtccggctgtatccccggcataacgatttcaacgagttcctgcaagcctgtaaaaaaaaagcaatgactgcaggaaatgagatgtaatacagcaaacaatatgaaagaagtatcagaaaagataacggaaagaatccgcaggaaaccggcctcatgatctgtcaccaaaaactgataggcgactatatgggcaggttcaggcttgtcagaagaaagcctgtggcgaacaggcataagacgaaccacaaggcttatatgaccggagttgatgacggccgccatataagtctgagcaggcaattgaaggataatactcttttttaaaaggataaaaacatgggctttgtcaacagactgatcacatggatcatggaccggctttccgtggaggtcgatccggatgccgaatggttttagcagatcgtgaaaaggatggttgcggttcatccccgttcacttgattaaaaacacataaacgaaaaaaatatggagataaaaggaaaagtacttaccctctttccggttaaggaaggagtcggaaagacatcgggcactccgtggaagtcccgtgagtttgtgatagaaacgcaagaccagtatccgaagaggatctgcctgcaagtgatgaatgacaacatggaccgttttcccatggaggagggtatggaggtcagtgtcaaatttgacatttccgcccgtgaatgggacggccgttacttcaacacgctgacggcatgggacatcaccgtgctgaattcccggccgtccaatcaggaaggagaaaacagatgagaaagaaattcttttttctggggatattgttgggcgtctgcctggcatccccagcccagttctattccgcacgtaccaacctgatagggctggcaacgggcaacatcaacctggaggggtccatgacgctgaaccgccgatggtcgcttcatctaccggtccagtacaatcccttcgtctttaaggataaccgccagttccgcaacctgactgtcatgccgggcgtgcgctactggttcgtggagtcctactccaatttttttgtcgggatgaacaccctggcaagcggctattcgatcggcaggatatggaacaagaaacgttatgagggagaaggctacggcatcggcctctccatcggcaaggcctaccccctgtcaaaaacatggaacatagaatgggaactcggcggcgccgcggtctgggcgaggtacaacgaataccgttgccgggaatgcggcgccttcctgggcagaaaacacggatggtatctgataccttcacgtgtggcgttgaacatgatatatcttttctaaatgtacggtcctatgaaaaaaagaaacatacctgtaatccttttacttccactgctgtccttatcctgttccctgtcccacaagatggaaaggagcatcagcaaggtcggtctctcacaggccggcaagcggcctgcaccggacacgacatgctattccgttcccgaaaaaatcacctggaaggacagttcgggagtggaacatattgtcaccatggccgaacgtgacagcgttacgggtgaagagatgaccgtgttgcagctggacgaggtgaccattgtcgcgcgtaacaggaacatccccgagcgtgccggaaaagtgaatctggattttgtcgtgaccgttccgggcaggctgatagatgacaaatggcaggtacagctgacccctgtggcctacaagcgtggcagacgcatagaactggagaggatcttcctatccggcgccgacttcgtcaagcggcagaaaaaaggatacgcgcagtaccaggccttcataaacagcatcatcccggattccgcctatctgaaagagatgttcgacatgaaaggctaccgccgtgccatggccgagctggaggaggagttctaccaggcatggaagcatgactatatcgcccgcgaggaatggattgactggactgagagatggaaccgccgttaccagcacttcaacgcgaagatggaacggaaccgcatggccatcgccggccacaacaccatcctgtccgtacttcccgcttactggctccgccgtgatctgtagatactaattgaaaagtgcgctgtattctaattgaaaagagctccatccatgttcctaatgggtgcctctaccggagcagcatacgcggtcgccaatcccggcgttaccgatgtgaaaatcacacaacaaagtggtacatgtacaggaattgtcaaggatgctacgggtgaaactgtcattggtgcatctgtagtagtaaaaggtacgactaatggtactattaccggacttgacggtgatttttctttgtcaaatgtaaaaaaaggagatatcattgttatttcttttgtaggatatcagacacaggaagtaaaatggaccggacagcctattgatgtaactttaaaagatgatacgcaacagttaggtgaagttgtggttacagctttgggattgaagcgtgaagaaaaagctttgggatatgcagttactgaagtgaagggagatgaattaaaagctgccaataccatttctccggtagccgcattgcaaggtaaagtagccggtgttgaaatctcaggatcagatggtggtttgtttggtggtaccaagatacagattcgtggagcttcaaccttaagttccaacaaccagcctatctatgtggtggatggagtgattctggataacggtgtatctggtaatacgacagcagactgggatgcaggtgccaacaacgccagcgactatggtaatgagttgaaaaacttaaatcctgatgattttgaaactgtatcagtattgaaaggtgctgcggcaacagcattgtatggttcccgcggtttgaatggtgcggttgtaatcaccaccaaatccggtaagggtacacaagggctgggtatcagcgtttctcaaacatttggtattgaccatgctttcaagactccggatattcaaactttatatggtccaggatacatgccgggacaatctgatgccgaccaaaatggaagtatgtgggatgaacatcagtttacagtaaatcagaatggagaacatacgttagtaggagtacccaactttggttttggtcctagatatgatggctctcaaatccgcaattatgatggtacatggactacctattctccacgtaaaaataatatgctggatttatataaattaggattcaatacaaacacgaatgtttctattcgcggtggtaatgaaaaaacatcattttatacatctttatcttataaaaatgccaaatcaacaacagaaaacaatacttttgaacgttactccatgttgttgaaagctagccataagttgaacgattgggtggatgttgctgcttcttttagctttgccaactcaaaaccgcgtaatgcacaactgaatgcgggtgaattgtttgtcaatgcaaataccaatgtgattaacccgctatttgacgtagattatttccggaacaaatatttaggtgagcatggtggtattgccagtaccagctatggtgaccaatatggttcggttccttccagcgctaaaaattatttcttcaaagtagataattacgattatgtacggaaggaaactgttattcgtcctacatttgaagtaaatgtaaagatgacagattggctgaagtttaaagcagacgctaatatgaaccgttattatacttctatagaagataagcaattaggttccggttatgcaaacgaaggaggatattatggtattacgcaagatataaaagaacaatttaccgtagggggaacttttactgccagcaagcagataaaagatttttcactcggtggattcgcacgatttgagtattacaacacctcttcccaacattcaaaagtatcaactgacggaggaatggtggtgcctggagaatggttcgtggagaactcaaaaaagactaaaaagagcgaatcgaccatatcgggcagcaaaagaattatttctgccatttttgctttaaatttaggatggaagaatcaattctatttggatgttacaggacgtaatgactggtcttctgcattggtatatgccaatcgtacaggtaatcactcatacttctatccttctgtatcaggttcatggttgattaatgaaactttccgcgaaagtatgccttcatggattaacttggcaaaacttcgtgcatcatgggcacaagtaggtaatgatacagacccatacgctgtcaatcagacgtattcttttgccacaatggaaatgtatgacggcaatatctataccaatgaactggacaaactgatgaagattgccgaccttaaaccggaacgtaagaattcatgggaaataggtttggatttccgtacttttaataatcgtttgaatttggatttcacttattataaggaaaataccacagaccagattatgaaaatcaatgttcctgctatttccggtgttacccaacagttggtaaatgctggtaatatccaaaactcaggtattgaaatcgcattaaatactactcctatcaaaactaaagactggcagtgggatctggacttcacttatacacgaaacagaagtaaaattgtatccttacatcctaatgttgccaactatattgaattgtccggttatgtaaacgcatacgactatcatatcggctctgtagcaaaagtcggtgagtcttatggtgtgttgatgtcagatgtcactcaggcacgtaatgaaaacggtgtacctttgttggagtgggatgacagctggagaggcgcatatagagcacaaagcaaaacagcggaagtagtgggcaacatgacacccgattttctgggatctgtagcaacaacgttaacttggaaagatttaagtttgaatgtcggactggatatgcgttttggaggtttggtagcatcttactgtaacttatacggaactcaggccggttggacagaaagttctttgcaataccgtgacccggaacatggaggtatgacttggactagtcaatacgccgattccaaaggtattcaatatactgatggtatgattccggaaggtgtttttaaagaaggaacaattgcgaccttggtggatggaacaaaaatggatgtcagcggactgtcttacgcacagctggtacaggaaggaaaactggaacccactcatgccggttcatggtatggaaataattatgcatggggagcacagacaattgatgacatttgggtacacaagttgagttatatcgctttgcgtaatattactataaattatcgtttgcctaatagcatcagtcacaaactgggtgcaaaaggattgaacctgtcattcagtgcacgtaatttgggatatctgtataattcattacctaataacctgaatccggaatctgtacgttctaattcagcttcagagttccgtattcgtggtttcgagccttatacggcaagttacatatttacaattaatgccaatttctaattgttaactttaaaagaattatcaacaatgaaatatagaactttagcagccgcactgcttttaggaagtgtaatgtttacttcctgtgtagatgaattctctgaattaaattcagatccgtctactattacaaagcctgatattcgtttcctgttcactaaatgtgaggcttctttccaaccgggagattatgcacagtggtttggaggatttaatgatctttctacctggtcgcaaacaacagtttcatcaggaggtaatacaactcgttcaaatcgtccgactgatgaagccaatggttgtggttatgaagtaaacgaagttcttcgttatgctaatgagattcgatatcaaatcagccagttgcctgaagaggaaaaagcgacttatgaatatatccaatatctttgtaatcctttgttggtttatttaagtatccaagatgccgacctatatggctcacgtcaatatacagaagcagaacaagccagatataccaatcctcctttgttattgcctaagtatgacactcaagaggaacttttggaagtatggctgaaagaactggaccagactattaattatctgagcagtaacgaaatcaaagatgttttgaataatcaggactttatttataaaggtgatttgaaaaaatggggcaaactggccaattctttgaaattgaaaattgcagcccgtttgataaacaaagaccggaaccgtgcttttgaaatagtaaaacaggtagcagaaagtcctgttggcttaattgctactacggatgatgactttgtatataacaagggtaagttcgataacaattggaataatgatttttctgtaggagtaggtacgcaacatcttatagactttttggtaaacaacaaagatccgcgtttgctttatttcttccaaaagaatgactacaattctaatgttgtgcaggcttattttgatcaaaaaagagaaatgccggattttgtagaaaagaatgtaatttctgaggttaaaaatggaaagaaagtctttaaagaatggggtggtccaggtgaaccttgggtacgttattatggtcttcctgtagaaataggtgcaggacagatggacaaatacgaggattattttgaccccacaggacaattgtttgttttgtactcggcagctggtgccaagaaaagctattatccgtgtacttaccggaatcaagaaatggtaaaaggtttgttgacatatacttatccggatgctccggatgttactccggttcaggacactcaacaatatggctggtatggtctgtatttttcggcagcggaaaccaatttcttcttggctgaattcaccctgttgggagctacttggaatggacaaaaaagtgcccaagagtattttacagacggtatcactgcttcagtaaaaggatatgattatgttgccggtcagaatcatataccttattatgacagtccttatgtaaatgaccctcatgatgtttccattaagctgcaagaggaatggctgacagaactgcttaagaaagaggcttataatttaagtggagataaagcttctgatttggaaaaagtgtatatccaagaatatctccattattttaatgcaccgattgatcaatatgttaacattatgcgttctggtgttcctatgaagaatagttccattttaccgcgtaaggaatttgacgaacaattgggtgactcttatcctatccctagaagatttgctgttatggagcctttggaatcagatcagttacatgacataactatcgctgcatataaagcacaaggttatacatatcaaggtacaaatgcaaaaaatccacaagttttgcatgacgaacgtgtatggatggataaagaaaatcctgattttggcaaaggaccgaagaactgaaaataaaattaaagaataacagttccccttgtttttcctgtaaaaacaaggggattgttttattttgaccttcaggactatacatagaattattttgcaaatattatttatatgtaagtaaagagttgattcttcttgaaaaagataaggactttctaaaacaatgagccgatgctgtttttatttgtaagatgaaaaactttcccatcaattattgaaagttctcattcttttacggaatgtaatactcccttatttctttgtgcaaagtagtgatttgggtagaaatgaagtagaaaatttccatttaaagtttgttttaacggctttaaatggaaatttctttttgtcgttatcatattcaacttcattgaatatcaatacaatagctgcaagagtagttctgaaggaactaaggaaacggaattacttgattttcaataaactttaaaaaaaatcacagctatgttaaaacgactaaaatcagtcagtatgttgctgttcctaatgggtgcctctacaggagcagcatacgcggtcgccaatcccggcgttaccgatgtgaaaatcacacaacaaagtggtacatgtacaggagttgtcaaggatgctacgggtgaaactgtcattggtgcatctgtagtagtgaaaggtacgactaatggtactattaccggacttgacggtgacttttctttgtcaaatgtaaaaaaaggagatatcattcagatctcttttgtcggttacattactcaagaggttctttggaatggtacccctttgaatgttattttaaaagatgatacccagactttggatgaagtggtagtcgttgcatttggaacgcagaagaaagtgaatgtgaccggtgctgtatctactgtcggagcgaaagagattgcggcacgtcctgttagttctacggttgaagctctgcaaggagttgttcctggcatgaatatttcaacaagtagtgatggtggttcattgaaaggtaacaaagaattcaatattcgtggtacaggaactattggtaaaggctcatcagtatctcctttggtgctgattgatggaatggaaggggatattaatgctattaatccacaggatattgagaatatttctgttttgaaagatgctgctgcgtcttctatttatggttcacgtgcgccgggaggtgtcattttgattactactaaaaaaggtaagtcaggaaaaccatctattaattataataataatttccgatttaactctccattgaatatgcctcatatggcagattcatacagttttgcattagctatcaacgaccagctgaccaatggaggacagtcgccaatgtatagtgagaagaaattgcaacaaattttggattatcagcatggtaaatctacacaatatatgtgggctacggatgctggacgttggaatgcatttgatgacccaaatcgtcaggatgttatgccaaccgctaatactgattggttgcatgagttgtttggtgatagttttactcaggagcattcaattagtgtaaatggtggtacggatgtaatgcagtattatatgtctgccaattatctggatgaaggaggattattgaaatatggggatgatggcagacaacgctattcatttactggtaaaatcaatgcggatttggcaaaatggttgaaagtagggtatagtgttcgttttaatcgtattgattatagttccccttcctttgcaagtgccggcgagaataaggaaaatgtattttattttgatgtatgccgttattggcctgtaattcctgttgtagatcctaacggtttttataccgcagagtctaaaatttaccaattgactgaagggggacgttataatactcagaatgacgttgtggcacaacaactccagtttcttattgaaccaattaaaaattggaaaaccactattgaattaaattatcgtagtaattataatttctcgcatacggattatcaaacggtttatgcttatgatgtaaacaagaacccatatgctattgccaacacaacttcgggagtaacagaatatgcatataaaagcaatttctttaatccgaatatctttacagagtattcattggagttagaaaacgggcataatatgaaagcaatggtcggttttcaaagtgagttgtttaaacaacgtgatattactgcaaaacaaaataacataatgtctggcattcctactttaaatacaactacggataatgcacgtgccagtggtggctatcaggaatgggcaacagccggtttttttggtcgtatcaattatgattacaaaggtcgctatctggttgaggcgaatctgcgttatgacggttcttcacgttttttacgcgatcaacgttggaattggttcccttctttctctttaggctggaatgtggcacgtgaggccttttttgagaagtatactaatattgtcaatacattgaaagttcgtggctcatggggtgaacttggtaatcaaaatacagataattggtatcctttttatcgcattattgattataaacaaaataatggcggttggttggtcaatggcttgaaacctaatactgcagccgagtccagtctcgtttcggcattgttaggttgggaaaagacccaaactttaaatattggttttgatcttggtatgctggacaatcgttttaatttgaattttgattatttccagcgtaagtcaattgatatggttgggccgggacaggaattaccaacaatcttaggtattgccgttccaaatgtgaataatctgaatatgacttcgaaaggttgggaattacaagtaagctggcgtgatcagatacgtgatttcagatatggtgtcacattggctttatccgacaaccaggttgtaattgataaatatcctaatccgtcaaaagatttaggccaaacatattatgatggggcacatttgggagatctttggggatatcagacaataggaatagctaagactcaggcggaaatggatgcgcatctggcgaaggtggaccaatcttctatgggttccaactggggagcaggtgatataatgtatgccgatttggatggtgacggtgtgataagtgcaaaagataatacagcagacaatcatggagataaagttttgctgggtaataagacaccacgatataactttggcttgaatttggatgcggcttataaaggctttgacttgaaagtgttcttccaaggaacattgaaacgtgactatatgccgggatcgggtgctgaaagtatgatgttttggggagctgtagggtattggcagaccaatttttttgagcctcacttagactatttccgtcctgctgatacaacgagcccgctaggagcgaatgtcgacgggtattatccacgtcctttagaaagcgacaagaatcgtaaagcacaaagtcgctatatgcaaaatgctgcttattgtcgtttgaaaaacgtaacgttgggatatactttaccggcagatttgactaaaaaattctacgtgaataatttacgtttctttgtgtctgcagagaatctgtttactataaccaatctgtgtgatacttttgatcctgaaacaataggtgtaggcaattgggaaggatgtacttacccattgtcaaagactatttcattcggattaagtgcaaccttttaataaaataagatctatatgaaaaattatattcaatatttaactatcggagctttgctgatgggcagcctgacaagttgtaatgacttcttggatagagaaccattggataaggttactcctgaaaaattcttttctgcagaagcggatttagcagcttatgccataaataactataagtttgttactgtagatgataagtatggcattaatctttttggaaaagataatgatacagataatcaggcaagcggaacaagtaattcgttttggattcctggtgagaaaaaagttgctgccgaccgtggcgagtggaaatgggaggatattcgttcatgcaactacttttttgaccaagtattaccaagatatgaggagggagctataactggtaaccaagataatgtgaaacattacattggagaaatgtacgtgaaccgtgcatatagctattttcaactttttacaaaatttggtgatctgcctattgtcacaacggcacttcccgatattcaaggtgaattggtggaagctagcaagcgccaaccgcgtcataaggttgctcgttttattattgaagatttaaaaaaggcggaagacatgttgttgaataatcctccgggtggtaaaaatcgtatttctaaaaatgtagcttatttgcttcatgctcgtgtagctttatatgaagctacttgggaaaaatatcatcgtggtacagcttttgtaccgggaggaagcggatggccgggtaaagatgcgcaaggttatgatgctgatgtggaaattaattatttccttgatgaagcgattgctgcttcgaagtttgttgcagaccaaatggtaggcaatttagcagagaatacagatactccggaaggaatgaatgcttcattggtttctatcaatccatattataccatgttctgtgatgagaatatggaagggtataaggagattctaatgtggaaaaaatttgatgaatcattgggggtaaccagtaatttgcagatggaactttgtcgtaatggtggtggatcaggctggacacgtggtatggtcaattcattccttatgcgtaatggtttgcctgtttatgccagtggttcggggtataatcccgattgggagaaggaaggtgtagttgctacggtacagaatcgtgactctcgtcttggtatattcactaaaaagccgggagatgtgaattattatggtgatgatggtacacccagtatttgtcaaatcagtttgatattcggtgatgcgggcagtttagcaacaacaggttatattgtaaagaagggtaaacattattcaactcatatggcgaatgaccattctgccggtacctctggaggtattgttttccgtggtgcggaagctatgcttatctatatggaagcttcatacgagaagaatggaactgttgacggaacggcagatggatattggagagcgttacgtacacgtgcaaaagtagatccggattataataagacaattgccgcaactaatatgctggaagaagcaaaaggggattttgccgcttattcacatggaactatgattgatccgactttgtataatattcgtcgtgagcgccgtaatgaactttgtgctgaggctttccgatgggatgatttgaaacgctggagggcacttgatcagtttaaaacgactccttatcgcacggaaggtatgcgttattggggtagtgtatatgaggaacaattaaaagatctttgtatagtaaatccgtcaacaggaaatatgtcttctcctgaatcaagtgtgtatatacttccatacgaaaaaatattggaaaataataccattgcaaaacaaaagggattcctctttactcctgcccattatttagagcccattggggtggctgtattccgtcagactgcatcagatcccaatgacttcacctcatcttcggtttatcaaaatccaggatggaaatatgaggctagtacaggggctgtttcggtcgaataagaatatatattgatattattttgtagggaagtctttttaggcttccctgcttttatttaaggcatttatttcctaagcgtgtattttaccttttgaaggtaggcatcgcttatctgtctgaaggtgtgatgaaacattatagtgaagagtatcatgaataaagaacttcatagtcgagggcatatgtgatgcggtgatctattgttatattaatgcataaaataaactattttcaagtgaatataaataaaataaaggtgaatgataatgtgtgatgatttaatgttttattaaataacggagattataataaaatatttttgtttatcttcttaaatatatcaaatatattatatatttgcagcgtcaatcttggtttagtttaagaataatatcttaaactggttgatttttaataaatatttaaagaatcacagctatgttaaaacgactaaaatcagtcagcatgatgctgttcctaatgggtgcctctaccggagcagcatacgcggttgccagtcccggcgttaccgatttgaaaatcacacaacagagtggaacttgtacaggtgttgtcaaagatgctacaggggaaactgttattggtgcatctgtggtagtaaaaggaactaccaatggtaccatcacagattttgatggtaatttcactttaaatgatgtaaagaatggagatgttattcagatttctttcgttggttatatcactcaagaaatgaaatggaatggaactccgctgaatgttattttgaaagatgatactcaaactttggatgaagttgttgttgtcggctatggtggttctcaaaaacgtgcagctttgactactgctattactaaaatggatgaccaggtcttaaagaaggcggcttatagtaatgtgggacagtcattacaaggatctgtatcgggattacgtgttgtcaatactacagggcagccaggtagctcacctaatataactttgcgtgggggagcaacaattacgggggataatagtgccgcattaattattgttgatggaatagtgcgtaataatatggcagatattaactcctcggatatagaatctatccaggttttgaaggatgctgcatcgacggctatctatggtgctcgtgctaatgggggtgttatcttgattgaaacgaaaaaaggtaaagagggaaaagtagatgttaattataaattcaagatgggtatgaactttgcccgcaaaggatatgaatatctgaatgctggtgattatttgtattatactcgactgggatttaaaaatgctaaccaagcggtagcaggatatagtgatggatggaatcctgatactcagaatggttgtggtacaactaaaaataactatgatgtacgttatttggaaggcaatgaggatttggtgaatcaaggatggcagacgatgactgatccttactctggtaaacagttggtttataaagattatcatggagctatggatgatgagatttttaattcacctgcgttgatgcaagatcattatatcagtatcaatggtggaaatgataaaggaacttttgctgccagtttagggtattatgatgaggatggtcaggtcgttggaactggttatcaacgttttaatggctccttgaacggctcctataagctcttcccatttttgacaataaatgcaggaactacttattcctggtctacacagcctacattgtcatggacaggtacttatgagttcttttatcgtacacgtggtatgcgtcctacttggaatccttggaatgaggatggtagtcctaattcggctgatactaatatttccgatggtaatcccgcttatttcagagataaattactgtattctgacggaacgaataaaagcacttataatataggatttaaattggatattcttccaaagaaattagtgttaaacggtaacgcttctttgtatcgttatgattacatggtggaaaaatttaataaagcgtaccaattggagaataaagatacaaatacaacacgtgaggcttctgtggagcaggaacgttatactcaacagcaatataatgctacattgacttataccgacacttttgctgataagcataatttggaggtcatgttagggggtgaatattttacttatgatcagtttaagcttgcggcaaaaactcaaaattctcctactgatgatatccctactttaaatgtaggcgcaactcgcactgaaactagtactactaagagtgcttatcgaatactttctagttttggacgtctgaattataactatgaaatgaaatacttactttctgttgtgttccgttatgatggtatttctaaattgaaggataatagatggggatttttccctggagtttctgccggatggaatattacagaagagcagttttggaaggattccaacgtttctgatttgatttccacctttaaacctcgtcttagttatggtgtgaatggtaatgtgaacggtttaggtaattatacggtatatggtgagtatgcaacaacgaaaccttatggtggtgaaaccggtatatacaatagtgcattggttaatacagggttacgttgggaacagagccaaagctttgaagccggacttgatattggtttcttcaataatcgtttgagctttattctggattattataatcgcaagacaaaagatttgcttaccgatcttgctttaccagggtatacaggatttgataagattgctactaatttgggtactcttcgtaattctggttttgaagcggaagtacgtgctaatatcataaataaaggtggattcacttgggatatgacagcaaacctttctactgtagctaataaaattataaaattgcctgacaataaggaggttaataaccgtgtaggtggtgctcaggtatgggatcctaataaaggagagttagtatgggttggcggccgtcaggaaggtggaaagttaggtgagcttattgcctataaacaaaatcatatttttaaagattgggatgatgtaaaaaaatatgcaaacaatcgaattgataatgtcgcaaatttgtatggtccgggtaaggcagcagaatatgcaggtaaacaaggttggaaacctattgaaccaggagatgtttgttgggaggatatggatggaaatgatgtgatagattcatatgaccgttatgtcgttggtaatatatttcctaatataaccggtggattctctactacattcagctataaaaattggtcgttgtatggacgttttgattatgcattaggacatacattgtataatgatttaaaggctcgtacattgggccagtatcaaggcacatggaatattataactgatgtgaaagatatgtggacagaagataatccgaacacagatttatctaaatattattttggcgatcagaatatcaaaaagaatatcacacgttctaataatggtttaactgctgctgataacaacaattctcattattatgaaaagggggattatttgtgtttgcgagagcttacattaagttatacattaccgaaatcactaatcagtaaatgtttcatgacggatgcttctgtttatgtcacaggtcagaatttgttttatataactggttatgaaggtacatctccggaaccggctgtaagtacagaatatggtcgtggtattgataatggacgttatcctactccaagaactgtattatttggtttatctgtttcattttaatcaacaagactcattatgaaaaaaatattagcatatttaatggttggcatagcttttaccgggtgtaattctttggatttggagccaataagtagtattgccgataataaatattggcagacagaagcacaggtggatgcttttaatgtggggttacattctaagtttagagagaaatgtagttatagcatttttctttttggagaacctcgtgcggattattattttggagagtcaacatttggtagtgctacccagggtaatgaacgtatgtggaacaacagtttgaacgatgtgaatacggttgtttctaattttggaaatttatatgaggtgattaatcaggctaatctgatgataaacaaggtggaaggtatgtcgatgaatgaaagtaccaagaaatattatctgggcgaagtttatggtatccgtgctttcctttactttcagttgttacgatcttatggagatgtagtgatatggaccgatttctcggaagggtcgagcttggatcttggaaatttagcaagaccagcttcttctgctgctgacgtaatgaaattgattgttgatgatttacaggcttcagaaactgcttttggggataattatgggtttagaaatgattctcagcgttatttttggtctaaagcagctaccatgatgttgaagggtgaagtatatatgtggagaggaaaacacatgggaggtggtaacgaagattatacaacagcgaaaaatgcattgcaggaagtgagaaatcaaaccgataaatttggtttgttggaggatttctctgaagtattttcttatgataacaagaataataaagagataatatttgcgattcgcaatgcacgcgatgaatataatatgtggggggatgtaacatataataataatatgtttccacagcaaaatatattattcggatatatggatgagaatggtaatcccattagttcattgggtgataaagtgaaagtgaatggtacgatccgttacccggttaataaggatgtgtatactaaatgctttaatgataacgatacccgtaagcgaagcacacttcaggctgcttatgaaaaaaaggaagatggaactttatctctttatgggttgtatccggccaagtttttgggtacattgcttgatggggctgatacgcgtagtccattggatgattatcctgtttatcggtatgcagattgcttgttgttgttagctcaagctaaggcttttttaggagaggaccctgtggaagaaattaatgcagtacgtaaacgtgcctatggtgaagattattttaatgcacatccggaagtacaatatcccaatgataatgatgccgcactttatgcggataataagtctgtaaaaccggataatgccggtgcaatggaagctgttctaaaagaacgtatgcgtgagtttatggttgaaggaaaacgttggtatgatctgcgcttagcaggtgatgaatatgtattggaacatactacagcagaagcaacccgtttgctttggcctattgataagaatacattgactaataattcggcattgaagcagacaccaggatatgaatctagtggaggaaaataaagtattagttagggacattcattaaatattacaaaatcagccaactaattcatacacaaagtattgttattaatagcattgatttgaattcaagaaagagtggctatgggtatggtcataaatatggctatggatatgggcacaaatatgggtatggctatggtatggacaatagcaaaaaagattgataaaaatataggatatgagaagttttgaaaaacttaaaatagcggtggctggtactggttatgttgggttaagcattgctatcttgttggcacagcatcatcaggtgattgcagtggatgttattcctgaaaaggttgatttgataaaccaacgtaaatccccaatccaggatgattatattgaaaagtatttggcggaaaaggaattgaatcttattgcgactttagatgcgacaaaagcatatagtgaggtagattttgtggttattgctgcacctacaaattatgatcctttgaagaattattttgatacttctcatgtggaggaagtgattaagttagtaagaaatgtcaaccctaatgccgttatggtgattaaaagtactattcctgtaggatataccgaaagtgttcgtcagaagttggatacggagaatgtgattttctcaccggaattcttgcgcgaaagcaaggctttatatgataatctttatcccagtcgcattattgtaggcaggccggaaggtgatgctcgcttggaagaggctgctcacatattcgcagagttgcttcaagaaggggcgattcggaaaaatattgatacgttgtttatggggcttactgaagcagaagctgtaaaactttttgctaatgcttatttggctttgcgtgtgtcttattttaacgaattggacacatatgccgaaatgaaagggttggatactcaagctatcatcaatggtgtttgtttagatccgcgtatcggtacacattataacaatccgagttttggctatggtggctattgtttaccaaaagatactaaacagttgcttgttaattatactaatgtacctgagaatttaatacaagccattgtggaaagcaaccgtactcgcaaggacttcattgccgatcaggtgcttcataaagctggctactatgattattataatcgggatgactataattctgtagaagagaaacgttgcgtagtgggtgtttatcgtttaacgatgaaatcgaattcagataactttcgtcaatctagcatccaaggtgtaatgaagcgtatcaaagcaaaaggagcagaagtgataatctatgagccgaccttagaggatggtagcacatttttgagtagtaaggtggtgaatgactttacgaagtttatggaacaaagtcaggtgattatagcgaatcgatatgatacttgtttggatgaaatgaaggagaaagtttatacaagggatatttttagcagagattaaataagtattttttagattaaatattgattctgatttataaacaagatggagaataatccttctggtaataaacgtattgctaaaaatacattgttgctttattttcgaatgctgttgaccattttagtagggctttatactagccgtgtagtgctcaatacactgggaataagcgattatggtgtttataatattgttggtggtgttgtgaccatgcttgcttttttgaattcagcaatggtagcagcttcccaacgctttatttcatttgaattgggtactggtgatttggaaaagctgaaaaaggttttttgtacatcagtatccatacatataactttagccattcttatattaattgttgcagaaacaattggcttatggtttgtcaatgcttatttgaatattcctctagacaggatggaagcggctaactgggtttatcaatgttcagtccttacattgattttgacaataataagtgtaccttataattcatgtattgttgcacatgagcatatgagagcttttgcttatgttagtattgttgaggtaattctaaaactagcgatagtctatctgttattaattggtgactttgataagttgatattatatgctatattgatagctgtagttgcttttattattcgaataatatatggtatttattgtaaacagaattttgaagagtgtacttatcattttctatttgatagaaaactatttaaagaaatgtttgcttttgcaggttggagtgttattggcaatttaggtttttcattaaaagaccaaggctctaatatcattctaaatctatttggaggaacaacagttaatgctgcacgtggaatagcaatgcaagttaatggaattattagtaatttttcttataattttacgatggctttaaaccctcaaataacaaaacaatatgcggcaggtaatatgaatgaatctggaagattggtatatacaggatgtcgttattcattttatttgctactattgattgcaatcccagttatgattaatgtcgattatttgttacaattatggttgggaactattcctaaatatacatctcaattcttattgttggctttaattacagcattaataaatgttatgtctcctccattaacaacggctttacaagcaacagggaatattaaagtttttcaaatagtgatatgcattattatgttatgtgaattgccttttagttattttattttgtatacagggggcaaaccttatatggtaatgtatcctagtatttttgtgatatcaatcggtttgttcgctcgttttctcattttaaaaaaaataagcccattttataaactacgtcattttacgtttaatgttttttgtagaaatatattgattgctattgtatgttactatatttcttttaaaattaaaaccagcttcttcttttgcgattttatttcatttttgttgacgagttttattgcttttattgtgtcatgccttattatttatgttataggattttcacctgaagagcgtaatgctttattgaattttatcaaaaataaaattagaaaaagatgaatagaatagactttaaaataaattctttgatctcttatatattgcaaatccttgttatatgttctattctttgtgttctacctgttttccaagaaattctttctgttagactttctgaacgaatcttagcattaataggtttttgtacttgttctatctttttttgtaggtatcattctttgttggataaagtaggctgggtatattgtatttcattattggttatttcaattgttcatactgatatggtgacagttgaaaatacatttatgagttccataagatggcttaatattttcttgttgatacttctgtataagaacttaaacttaaatacgaggtggctgttatattttgcgtttgtattttacataaccgaatgcggaatatgtattattgaaaaactaggtaagttttatgttatagattattctatggcagattcgatgcaagctacgaatgcaaaggcatatcagtatacttttatggatttcagaagcagaggattattgttacatccactttataatgcgaatgtaatatctatttttatgggttatatattagtttccagtcgtttaaaaagatattttcaaataatattgctgttgttgggattgtttgctgtatggtcttgtaattcaagaggatgtatagctgtttggttgttgatattgacttataggctattcttttataaacagaatgtgtggaaagtcttaattgcactgttttttctatatatgataattccaaatgttattgttcttgtacaacagtcaggattattgggaagatttaattttgattttagcgattcatcttccgaaacgcgactaacagcctttgaattattttttatatacccatggaaaactgaggatattgtttatggattaggtgattggatttattatccatttacagaaatacgattggaaaatggttttcttttaaatttatcttattggggatggattgtaggtagcatcaagtcatttgcggaaatttatttgacttataaatgtttgtctttttactcatttaatgataaaattatcattatgcttgccatttggggtgtagcaagcttaaataataacatgacatatattatgctgttatcattctttttattggcaaatatattcttaaatacagaaaatcattgtggcatgaaaataaaaaatattttcttcctttttaaaaaatagaaaaagtctttcatcatatgaaaacaaagattatttatgtgcttgttagtaatgaaaatgattgttatttagagcaggcattggtttctatttattcattgcgtttatataatccagatgcaaatttgcttttacttgttgatgaagaaacaagtagaacgttggaaaatggcattcgtaaattgatacttaattatgtttcaaaattagtcatcgttgatgttccgtttcattattcaaaacaacaaaaatctaggtacataaaaacatcattaagaagtcaggtaattggggattttttatttattgattgtgatacaattataaatgaagagttgaaagatatagataatttgtcttgcgaaatagcagctgtgccagattgtcatctttcaattaaatatagttggatgaaaactaatattaagaaatggtcttctgtattgggatggaaatattcagagaatgatttttattttaatagtggagtgttgtttgttaaagatacagatgatactcatcaattttatgagtattggcattctttgtggaggaaaaatgtattgaaaggtattaattatgatcaaccttctttggctaaagctaatgaattaatgggttgtaaaatttgtaagttagatgatatttggaattgccaaattaatgctaacgggttaccattcttgtctaaagcaaaaataatacattatttcgcatcagggatgggagcaaaaagttatgtaccttataaattccttgataaaaaaatattctgtcgtattaaatacgaagggtttctgagtgatgaaataaaattgatgattagaaattctaaatcagccttcaatcctttttgtactgtaataggttatgacgatgctagatttttatgttctagcacttatgggttatatattaaatatcccaatgcttataaaataatcaatgttatgtctcgtatgtttttatttctgcttcgtttctttttaaaaaaataatttaataaaattgattcacttgatatgattcctaaaattattcattattgctggttaagtaacgatcccattccttccaatatccaacattatatggattcatggaagaaatatttgcctgattatgagtttattcattggaattttgataagtttgataaatcatcatctcgttgggtgagcgaagcttttgataacaaaaaatatgcttttgctgctgattatatcaggctttatgctctgtatcattacgggggaatttatttggatatggatgtggaggttttaaaatcatttaatccttttttgtcacttcaaacgatgatggggtggcagtatggtaaaggaaaggggctggaagttgcagcgtttggtgttgaacggcattcttcgtgggtaaaactttgtttggacagttatgataaacgtccatttgttcttccggatggtagttttgatatactgcaaccattgcctttgcaggttgaaaaaacattattaaataatggttatgacttgatttctgttacttctcttgaagatgcgatgaagatagatgaagcttccatgaaaatagcaattttccctgcaacattttttagtccgaaatcttttactgatggagtaataagaactaccactaatacatattctatccatcattttgctgcatcttggctccctttttatacgcgttgggaaattaaattttggcatctgctgcggttgcctaattttagaatattgcattttattggacagcttttgaaaaaagtgcatctgaaaaagtaaatagttgatacttgtaattctaaaattgtattattttgtaagggggagctatgttttgtaagtattcaaaatagattttcatttgtaatgaactataaaaagtttattcttttagtatttgccaatgtaactatagttaagtgaaatttaaaatattcaactttttgccttattgattttaaagagctgaaaaagactacttactaattataactacaataaaatataatggaaaacgatattcccaaaataagtgtgattgtacctgtttataacgtggaaaaatatctagataggtgcatacagtcgatattgaatcagacattaaaggaactggaaatcatattggtggatgatgggtcacctgataattgtccagctttgtgtgatgaatatgctcaaaaagatgcgcgcattaaagttattcataaaaaaaatgaaggattaggttttgctcgtaatgcagggttaaatcttgcatctggaaaatttgtttcatttcttgattctgatgattgggttgctcctgcgatgtatgagactctttatcgtgtagctgaaaaaatgaaatgtgatactgtatattgtagtttgcaatattattattcaaaagataagataataccttttgaagaggtaggtcaggaagtcttttttcgtggacgaaaaagtgttgattcatttttattagatatgttagctcctttgcctagttatcgttctgatgtgaaatatatggtttcagtttgtaaggctatttatcttagaaaaataatagaagataatcaattgcgatttgtatctgaaaaagtggtagcttctgaagatatgttttttcatgtgagatatttgaaattagcagaaaatgtaggttttataccggaatatttttataattattttcaaaatgagtgttcaattacccatacttatacagaggataaaatagaacggttaaagaggtttattcaagagatgcattcagtatttgcagagtattttgcagaagaggattattgggttaggttacaacgcaaagctctgcattatttacgtaattctctttatattaaatatcaaattgtaaagaaaaaatctttttcaattcagaattatgaattaaaacaaatatgcaaagatgcatttttttatcattacttaaataattatccgtatcaattgttgccaatgaagcatcgccttttttatttattggtaaaatatagagctactttattgctgttgttggtatataaattaaacaaaaaatgaaacctataggcctcgtaacttgctattttcatcataactatggtagtatgcttcaggcatatgctacggaaatgatttttcagaaaatgaatttaccttatcagactatttcgtgtaaatctcctattgtttatatgcaagggaataaattgctttatattatcaaaaagattttgatagctgattggaaaatgaggataggtaagataaaaatagagtattataaaaagaaatatccagattcatttggcagaaatgtagatttacgaaatgcttgttttgataggttttcgcaagaatactttcatttatcaccttattgtaaaaatagagaagaattgaaagctatggctaacaattattctgcttttgtggtgggaagtgatcaattgtggcgtaccgacagcgtagagcatgggtattatactttagaatgggtgccagacaatatctgtaaaatagcttactctactagtcttgggattaaaaaagtaccttggtttcagaggaagaagaacagatggtttatgaaacgttttaattatatggcattacgagaaaaaagcgcttgtgatttggtttataaattaattgggcgtgagattcaagtcgtacttgatcctactcttttgtttacaggtgagcaatggatgcatatacagcaggaaaagcctctaactaatggtaaatatattttttgttacttattagggaataatcctcaacaaaggttatttataagcgaagtgcaaaaacgaacaggtctgaagatagtggcgcttcagcatttggatgaatatataccatcggatgaaggatttgctaatgaaactccttatgatgtaggtcctgccgagtttttgaattatgtgagaaattcggaatatatctttacggattcttttcactgctctgtgttttctattctctataaaaagaacttttttgtatttagtagatttagtgaaaatgctatgcaaaacactaacacgcgcatagataatttattgagtttgactaatctctctcaacggaaaatagatacaaaaaagaatatcgataatcttctttctatgccgcttgattatgtggatgtagatgagagattagaaatattgagaaagtcttctctagcttatcttgagcaagctttaaaaggaatagaattatgattgtaattactgataaggtcacgtgttgtggttgttgggcatgtgaaaatatttgtccaaagcattgtgtggtgatgaaagaggataatgaggggtttcgttatcctgaagtagatgttgaagtttgtatagaatgtggtttgtgtgaagcagtatgtcccattcttcataaaccgattaaagaacatgaagaaacaattggttatgttattcagcataaagataataatatacgaagagatagtacatctgggggattttttagtgctatcagtgattatgttttgaaccaaaatggatatgtttttggtgctatttataataaaaagatggaggtggtacattatggaactaataagaaagaagaaattcaattatttagaggctcgaagtatgtacagagtaaaataggacatacgtatcaagaagcaaagaaacttttgcaaactggttgtcttgtatgttttagtggaactccttgtcaaatagccggattgaagaattatcttaagaaagactatgcaaatcttatcacagtagatttggtatgtcgtggtaatccttcaccgcttttatttagaaagtatcttgaataccagcaaataaagtataaaaataaagtaacaggagttaagtttagggataagtattatggttataattattctactatgactttagattttgaagatgagagaattcaatatcattatgggatggaggcagatttaatgttaaagttcttttttaaagggctgtgttcaaaaccagcatgtcatcagtgtgtatttaagagtattgagcgggttagtgattttactatttttgattgttggaatgctaaattttacaataaaatcatggataaagcaggcgctactcatgtttttattcattctcaaaaaggatttgattattttgaatatttaaaatcttattttgtatatcagaaatcaaatgttcaaaaggttgtagaacaagatggttgtatgatgttacaatcggcaattcccagtacgagaagggcagacttttttagagatttgaataacttgccttttgacagattacaagcaaagtattttcctcttacattgatgagaaagattatcattaaaatgaaaccatttttttatcatatagggatattcagtatttatatgaaattaaaaaaaatgctatgataaagattttattaagcatatatttattattgtcttcttttgtattgtttgctcaaggtttatttgaaaatgatcctatttggcgagatgaatttaaccgagataatgttcctagttctatgtattggagttatatagtgggaatgagagggcaggaaagtgaatattatacaaatagttcaaataatgtatgtgtaaataatggtaaattaatcattaggactttagatgagaaaaaagataaggctttatgcacttctggtcgaatacataccttaggtaaggtttcgtttttatatggcaggttggaaattaaggcaaaatgtcctacaggaaaaggtatttggcctgctttttggatgttgccggcagaagaaggtttaccttttggtgaaattgacataatggaatatattgactgttggagttctaaggagtatcagatcaatgtccatgtgacggataaaaaaaatgggaatcgtataaaaaaaatgaatcctcaattagtgaaagctgatgtttctaaatttcatatttatacattagaatggtacaaggataaacttgtatttttacttgatggtaatttatgttatcaatttgataaaaaggaaggagaagcttggccttttgataagccatattacttaattttaaatgttgcttacggtggatggggtggatcttgtggaatggatgattctgcttttccttgtgaaatgaaagttgattggataagatactataaactcaaagaatgatgaaatacattttagtaatagatcatatagctactggaggcgcggaacgtattttgattgattactaccactatttgaaacagaatggacatgtgccttatgtttttgtgctttcaggttatagtggacaaagcaagtggacagagaatgtagatgtattttatgggtcttgtaatgacgaaaataatttgataaagaaaacgttacaacaatttaatctattttttagactaaaaaaaattgttgcagatataaaaccggatgtcattttttcttttcttgaaaaaagtaatctactgacgattcttgtgcctacttctgctgtaaaggttgtttcggtgcataatgtactttctcttcaatatacgaaaattaagttgggcatagtacagaagttaacttattgtatgataaggtggatgtataacaagtgtaataacgtagtagctgtttcaaaacaagtgaaagatgatttgatcgtttcttttggggttcggagtgaaaatataaatgtcattaataattatgttaatagcaaagatattaagattaaatctcaatgtggaattgatgattttgttttctgcccagataaaaaatatataatgaatatagggaggttttcagaacagaaagcgcaatggaaactactgaaggcattttcgctttatttgaataaaggtgggtggaatgtgtatcttgtattaatgggggagggagagtatatggaagaactaaaacaattagctaaagatttgggagtttattcacgaactatattcttgccttttaatttgaatccttataaatatatggctcacgctgatttgtttgttttatctagtatatttgaaggatttcctatcgttcttgcagaggtgtcatcgttgagaataccttttgtaggtacaagaaaagctataccagaagaaatgtttgacaacaggttgttttgggaggaatgtattgttgacaatttaatactagagaaagatttcacaacaattattcatgatgatgagaaacatttagcaaagttaatagagcgtggtatagatgatgatgattttaggaaaaaaatattgaatcataccaaaatatgggaagaaaacaatgataaaagtatgcaattcttattttatgatgcaatgtgtaggaaagtaagcactaaaatatagtgctctattttaaaagttacactatttattctttacaggaaagtgttatgatacctattttaattagtcatatcttacgaacaaatctacgaggtcttgataatcttttcatggataaaggtaaaatatatacatttctaaatcctgtttcttatttgatggcattagatcgtaaagatttgtttggacagtttgatggtatttttgccgatggttccatcttagtggctgccataagattattatatggaataacagtgaaaaggcgaagctttgatatgacttctatggcaccggaattattccgttttgccgaaaataatggaaagatgttatacattgttgcgtcaaaacaagaacaggtagaaaaagctgttgaaatatttaaggaacggtatccaaagttgaagtttatgggttgtcgtaatgggtattttgtttcggaacaagaaatggatgcggaagcgaaacatattacacaagttaatcctgattttcttattgtaggaatgggggcgttgatgcaagaacgttttttgctaaaggtgcgtaatgccggattccagggtattggttttacctgtggtggttttattcaccaaactgctaataatgagattgaatactaccctctatggatagatcgtatgaatctgcgttttgtctatcgtatgtataaagagaagcatacccgtaaacgttatgtacaagctgccttactttttcctgcacgctttttgtgggagaaactaatcttttcatggtacaaagatagcaaacccttataatttcgcaatgcataattcttttttagcttttctatgtttatgtttctgtactgtattgaagggacaggcattatatggtactagtggactattgcatatgcctactgctgatatgcagaaggacaaaactgttatgctgggcggtaatgtgctggataagcatccgctttctacttattggaataataaaaattacacctacacatataattactatataaatgtgactatttttccttggctggaagtagcatatacctgtaccttggtaaagggagttaaaggtaattattggcctgaacagacttggggaaaatttcgtaatcaggaccgtaatttttcaggaaggctccgtttatggaaggaaggctggtggaaagaatggactcctcaacttgtattgggagccaatgatcccggaagttttgataataatggtggtggtaatatcaattttaatcaagaagctggtactcataattatttcaatcgtttttttctggctgcaacgaaacatttgttttttcagaatgtgggggaattagggcttcatatggcttatatttatagcagggctactggcttgaattatgaaggacctgcattaggtgttaattttcggtgttgtttgcctgatacttctttgggaaataagatattgaatggactgaatttgatggcggaatatgatgcacgaaccattaatataggttttaactatgctgtttggaaagatcgttttaatctgatagcagaattgaatgatggtaaatatctgagtgcgggactttatttcaaaatctgtttgaagtaaacaggtatgagagttgataatgatagccacatatatgatcataattttttaaatcatactactatgactatgaaagacaaattagcatcctacaaccacttgatcgagacctttgtgattgtcaaacattttgagtttttaaatttataaatttaaagtttttctattatgaacaaaaaatttttaagtgcaatcctgtttggagcccttatggtcacttcaacaggaacatttgtatcttgtaaggattacgatgacgacatcgaccgcttggatcaagaaatatccaatgtgaaagatgcaatcaaggcccttgaagacaaagtaggctcaggcaaatatgtcgaaagctgtactccgttcactgatggtaatggtggttatgaaatcaaattcagtgatggagagaccattaaattatacaatggtgcaaaaggagaacaaggtgaaccgggcaaaccaggtactccgggtactccaggtacttctgctgatgattatgtagtatcagtagaagaaggtgaatcagcttatgaattagttattacttatgctgatggcactaaaaagactatcagtatgcctaaagctacttctgtagttagcggagttaagtttatccctactttcctttctgaaggtgaagctgccagaatccatttccctaccatcgttactgatagtgtggcaggtaaaacagagattacaggtgcagattggggtacaaataactttagcacatttaaaatcgtttactcaggtaaggcagacgtgaagtatcaggtaaatcctaacagcgtatcattcaaagatatggaagtggtaggatttgttcgtgatactgctgaaatatggaactacaatacgaataacaagaattgggaattgttcaacgctggacaaaaactgtacactgatggaaaaattaccgttgaatcttataaagaaggacatggtatgttaaacttccgtgtaaaggactgggcttttgctgaacaatctaatctggacgaaagaacagtatattcattgagaattaagaacaatgaccaaatcgttcattctgattttgttcccgccaagcatgaagtaattttgcagaaaaacgtacatttggttaaagtagctgatgcatttgaccaaactaacgctcctgctcagattaaaaatgcaattgctcctaacaaggtaaattatagagaattcatcaaagatgaatattatcttaacaccttgaatccgaccggtactgaagaggctaaattgaaggcttatcaagcagataaagctaagttcgaagccaatgctgaaaaccagttatataaaggagatgctgaatctaaagatgatgcagaacgtattgttgtagaattgaactatacaggtgatggacattcaaaaaatttgaaggacatcgtaacttcattctttgacaaacgtatgggtagagcccaagacgctcagtatcctttgatggagaatggttttgatgactattcattggtgtttgaaccggttgacttctattatgatggcgttaaccagacaaaacgttatttggatgttaccaaagatggtgttgctacagtaaaacaaactccggacccgatttggggcgcagaaactgatgccagccacacagctgctatagacagaactcctattgttcgtgtgaaactggtagcaccgggtgaagacaatggtaatgtagttaaaacagcaatcatcaagattcacattgtacgcaagacagttgttcctgaaattaatattacagaaacaaaagatgttactctgaaacatatcaatcaagttcttgacatggatatggataagatattcaaccatgaagatgtacagttgagtaaagacgaattccgtaagacttatgttttcgttcctgaatttgcaacagcagatgaggctaaacaacacgctgtatatgcatgggatggaaaagataataaagactattcattagatccgaactttgaaactaaagaatacaatcagctattcgttacagtgaagaatacagcattctctcgtcatgacgatcacgacgtttacactgttaagggtacatacacgccaaatgctgatcataagggattacctgacatccatgttacttatactatcaatgtgaagtatccgaatgtagttgctcctgaaaagactaagttgaactgggtagatgattcttacttcattgctcacggtagatacgataactttgatgctcctacaacttatgaaatggttgcagtattgaatgacgagttcgatttgatcaactataatccttataagggtcagactcatgataaggattgggctagagctaccttgtcattcgaattggttgaccagcataataacgcatctaagataggtgacggtcacgattccggtatccgtttgtatcaaggtgaagacaacaagtggtatatcgctttggatccgacagacgcaggacgtgcttggatcaatgctgctgacgctaaggatttgaagaagatcaaaatgcgtgccgtagtaagcttcaatgaagatattgacggattgtatggtacttgcaacaaggaagccaatgctcatcacaagtatgctaaagaagcttacaataacttctcttgcaatactatcaatatgataaacaatactccttgggctgaagataaccatactactaattatactggtgctcctgctcctgaaaatggacgttctacagtggttatcgatgaatttgaagttgcatttgtaactccgatggtattccacgcttacgaagcaggtcctttgtatgacaagtatcaggaagctgaaaatacagtatcattgaaggatgcattcttcttgtcagattatctgtggtctgaaggtgctcaggcacaattcaataacaaccatgttatctatgatcacaaagatatggctaagaataatactttggttcagacaggtgatcaagctggttggtcaaagaaactggtagttgaccataatgtattcaatgttaatacaactgttaacttcaaggtttctaaggcatactttgctgacggaagtgaactggatgctgaaaacatgaagaagatcaaacttgataatgctaagcagactatcacatggatcaacaatggtgaagatattgctcaaccatttactattgatgtagaagtttgtgtaaatcacaagtggggcggtatctgcgaccatacttggaagaatggtcttggacattctgttggaactatccaaatccaagttaagaagcacaatgacaagtaattaatacgctcattgtttataaaaaaagaggggggcaaaatgttcccctcttttagtttttataatcgtttatccaattatattgtgtatgaagtatatatatgctgtctgttttctgttattagtatgtggctgtcataaagaaaatgacacccctgttgttttacctgcacggacactattggtttatctgggaggagataataatcttgatgccgaaacctatgacaaacttgttcaaattaaaaatggatgggaagacgggacagatggaaatataatagtgtatcaggatacaccatttaaggactctccacgattgatggaaattgatggaaaaagtgagaaaggctatattaccatacatacctatgaccaagaaaactcagcctccccccaagtgcttaaacgagttataaacgacgtaactcggctttatcctgctaaaagctacggtctaatcgtgttttcccatggcagtagctggcttcctccacatacattggttaatggctcgcggtctatcatcatcgataatgacaatgaaatggaaataacagattttgccatggccctcccggaccatttatttgaattcataatctttgaagcatgtaatatggcaggtattgaggtggcttatgaattaagaaataaagcagcatatatcatggcttcctctgccccagtagtatctccgggatttactcctatctatgccggcagtatttcctgtctgcttgaagaaaatgctgatttgcaaagatttgcagaaaattattttcattattggaatttgatggaaggcgataaacgttctgctaccattagcataataaaaactgccggattatcaaatttagcgaatttgatacgacagatcaatacagaaacatccggctcttttctcccggtcggtaaccttcaaaattatgatggagttttaaaagccccattctatttttttgatttcgctcaatattatcaatcattatcagatgaaaatacatacaatgcacttcaagagtgtatcagccaatgtgtggtttacaaaagaaatactcctttttatgctacggaagaaggaacattccctatcaccgccttttcaggtatgaccacttttatcatgcagagagaacttaatgacttgaatgaagaatatacaaaactacaatggtataaagatattaatacacattagagaacatgtacaacactgacaaacaatgatatagcaaattcagtagaagaagtatatcttattgcagaatagatagattctaaatacttttcaaagtatcctttaaaggacagaatgccaatatatatggacagaaacaggtgattatccattaataagaaacggaaaaacttgtcataagcagaaaaaacaaatcctttatttgctttgtttgtcatttactaatatctttgttttatcattcattctagaaccgcaacaaaatatgaaataccctattggaatacagagttttgaccaaatccgtgaagatggctatgtatatgtggataagaccggtttgatttacaacttggtaacacaaggcaagacttatttcttgagccgtccacgccgttttggcaaaagcctgctggtaagtacccttgcctgttatttccagggacgcaaagatttgtttgccggactggaaatcgacggattggaaaaggactggtatgagtatcctatcttccgtatagactttaatggaggactgtatacacaacccggaattctggaggctaccattgaaggctatttaggaaactgggaagatatttatggcaagaatcccaattatacaaccataggaacccgtttcattgaaatacttcgccgggcttatgaacagacagggcggcgtgcggtggttctgattgatgaatatgacaaacctattttggatgtattagatacggaagcttgtttttatgatgattatggaaagcaagttctgttggagaaccataaccgggaaatattgaaatccttttattctacctttaaaggagccgatcaatacttgagattcgtattgttgaccggagtaacaaagttttcccaagtaagtgttttcagtggatttaaccagcctaaggatatcagtatggatgaacggtacgaagccttgtgcggtatcacccagaatgagctggaagcatttttcgaagaacccaccatacagttggctgctaaatatcagtacacagtgaaagaaatgaaggaacttctcagacggcaatacgacggatatcattttggagagaggatgaccgacatttacaatccgttcagcattcttaatgcttttgacagtatggcaattcgtgattactggttctctacaggtactcccacctatttggttcgtctgctgcaacacagccgcgagcagataaacgaacttgccggacgttattatgttccctctttgtttgtggattataaggctgatgtggaacagcctctacccatgatttatcagagcggatatctcactattaaagaatataatagacgtatgggaacttatctgctcgattttcccaataatgaggtgcgtaaagggttcttgtccgtattggcagcacattatttgaaacccggaggtggagaggtcaacagctggattatcgatgctgttacttgccttgagcaagggaacacctccgctttttgtgattctctgaccgcctttcttgcaagcatcccgtatgactctcacgcttccttgaaggaattggatatgactgagaaacatttccaatacactttttatctgattctccgtttgataggagtttattgccgtgcaatccattgtgagaaccgccagagcttcggacgagtggactgcatattggaaatggacgaatatgtttacattttcgaattcaagatggacggaacagcagaggaggctttacagcaaatagcagagaaaggctatgcccgatcttatttgaccgataaccgtaaaatagtctgtatcggggtgaatttttcttcccttacacgtactgtggaagaatggaaggaaataatttacaggtaagatttagtcatagtcagcctaaagcgttaaacaaaagattgccttccactattttttatgggaatataccggtaagaatgttcatgctgttgccggcataacacatttaattttcatctttttatcattttgtttttctttttgctaagaatgaattattttcgcagccgaacacaagtttaatttcttaccgacaataagcagacatgctttaatcctcgaccaattcaacttgtcctcattttaattttaacggataagctgatgttttgtccctcactattataaaataaaagaatgaaaagatcactgtatgtatcgctattgacgatcatgtacttctctgcctgccaaggtagtgaggaattagagcaatcacaagaaaaagagtacacggtatccattatggcaagaatcgggaaaacagtttccggagcacgctacttgcaagatcatgaaaatgccatcgctagttttagtaaaaccgatgatataggtgtttttatggacaatgacagcgccgtccgctggatattcgatggaacttcctggactacagaaaagagtgtcttttggaaagataaaaaccaggaacatactttttacgcatattatccccactccggttccaaagccgaaagtaaggaaaatataaaaatgccttctctcgacagccagaacgggacttgggaaaatattgaccaatatgactttctagtagcatccaggaagctttcctacgataccgaccttggcaatgtggccttttcgggcgattattcatttaagcacgttttgtcactattaaagataaacataaagggtgaaggagatatggcacaggccgttattgacaaaatcagacttgaaggaaatgggttgacgacccaaggatactactcctttgaaacgaacagcatcaccattagcgaaactcccaaggaaaccttccagattactccgtcacacaccatgaacaatcaggatgtttctttttattttatcctgaacgggggcgagaatgacggaaacattgatccgaaagccgtgaaaaaccattctgttaatctcaccattgaatatacccgtaacaacaaatattacataacacgacgagacgacctgtctccgggcttattgtccggatgtattcataaatacaatattgtagtaaaagacggaaatgtaattataacgggaggaagtatttcgggttggactccgggaaatgaagaagaggatatagttataaatggagaagaaataaacccacaaacaaataatatgttatgaattatagattaaccgaattaaaggtgcttctgtttctattgctactgtctgctgtttcttgccaacgcccgatgtatgatgaagaagacgatgaagacggagtctcgcaaacaaatcttcctttaaagatatctgccaggtctagcggagaatcccagattaattatccggcctatatctatgcgtttgcagaggacggcagctgttctgccagtctgaaaatgacagataacgcccagattgaaatgaagttacctcctgcccgatatactattgttgcaatagccggtttgggagaagaatatatcgttccgaaagatcctagccttgatgatgtaattgttatgaaagaaaataacagaagctcacgcgcgctaatgatgggcacttcaactgtgacaattgccaataagaaaaatatatctgtttctgtaaccctctattatgctgtatctttagtcaatatcagtttggaagatataccggcaaacgttaaaaaggtgagtttgcagatttcgcctttatattcttccctgtcgtttacaagggagtattccggcaaagacaagagtacggaaattatttgtgagtctgagccgggtggaatttggagtgcaaagcctttttatatttttccggggagcggctctcagaccgttttttccataaccttggaagataatagtcagacaaagacgtttggatacactttcaaaggaaagccggaagcgaacgtaccattgaatatcgggggtagctattcgggtgatgtcacggtagggggcagtttgatatcaggtgaatggaaggctccggtagacatcaaattcaattttggcggtgctgatgaaggtaatggcggtagtgagccgcctcccattaatccggatctttccgggctacccgaaattggcggtatctggaacggcggtattgtagctggcatagagaatgcaagttccacaggggcggatattttgttgatgagtctggatgagtggagtggattcgcttccgatgtgcggaatatcatacaggaggaggaagcagacggatggcatcttccgactgaagaggaggcaaaaatattgcataagacgttcagcggatcatcactggatgaactgaatgaaaccatagagggattaagaaacggagacccgttattggatattgagaaacggtatgtatatgatcataacgggagcatatatgcattcggatttaaaacctcatccaaatttttacaggcagggagtacggtgaaatacaaaatacgtttggtatgcagcgctcattatgatgccggatgacccattcatatactagaaaagggcattcacacttcttgacaatatatgcttgagagtgtgaatgcgtctaatcgacttccataccaggaatcccatttccatagataaattctcaattaattgaaagttaacattctaccacccggtatacatttcccttggtggtatgtacccgttcgcccagctggggcaggatacggctcaggctgtaggcggtcatccctctcatgatcgaaggatgggcggccttcatgcgttcaaacagttgggtggcggagaggctaagcacttcctgcggattgtcctcttctgtagcaaagcgaaagcaaaggcggaacacctcttcttcgggtacatgcttgtagaatagggcattatgttgctgtatagtctgttcctcttctttattgaaccagcttcgttcaccggatagaagttctgttttaagctgggcgtacaattgcttatgctctacggacgtggtgcagtctatggcatgcttcagactgacgcaaagaaagcggcgtgagccggtgcggtctaccagcaaatcctcccggttgctggtgccgatgaacgaggcaatacggggaagcgatgaagcgctgtgtttgtaggccttgcggatattcagtgcggaagcttgcatcaggttcttcagcaaaggcattttggacgcacctagtttgtcgaattcatccaggttgattaatccgtaggcagccagcttggcttcggcggatgccggggagcttaggtcgtaactttccgtgtagtaggatttcagcctatcgggcatcagcagacggcagaacgtacttttccccaatccctggcgactgctcaccagcaggggagccacactgttggcgcggttgttatccggattgagctgcatccattgggcagagagtcccagcatccaacggtggaaaccgttcacccataccgggtcgtcggacaccctgcgtgccaacgcggacacccggtccgtgccgtcccattcgggaagctgttcaaaataggcagtaaagggatggtattcactgatgcggcgtgagcgcacaaagcgttgaatgtccctgtcccaacagtctatgcccgtttcaatagcctccagacttagtgagttcatccatcgttcgtccactttggcgtaacgcagatgagtatcgggaatgttgttttctacacttgccacttcagtttcttcagtaagcacattgaaccggaagcggtagcgggaggtgaggaaagcggtcacttcctgcatcagggtatgtgatttcgctttcttgccagtatcttctgaggagattggttccgcttttttctgaacatcttttttcaagtgagcggaatccttctctgtcttttcagttgagactgtcggatgtgtccgagaatcgtccatactccccggcaggttatccttaccgttttcagtgagaagaacctgtgagtcggccatctctcttactccgtcttcgtccgacacgatgtagtggtaactgcccgtgggagcattcccgtcggtgcgcggagtccagttcaatgccagaactacttggccctcgcggatatccagcgccagacgcacgccgggtatagtccggcaaagcggcatcagcccgttgagagcggatacgagatcacgacgcggtgttccgtcaataggaacagggcttgacaggaatttgcttccgaagaagactgttttgagagtagcgaatacattcatgagttacttttttaagtttggcaaactacaaatatacaacataaaaaggcgtttgtcaagagggggcggaaatatggcagatcttggtgcaggattcgatgaaacttggtgcaagatttaatggaacttggtgcaaaattcaatggatacagggcgcaatacatacgtatgtgtaggccgatgcttgcgtatgtgtgacccgatgcttatgtacgtgtgggcttacacgttactaacatacgagctgacacgttactaatgttggggcttatacgttactaatgttattgttgaatacgcctttatgtttttaaaatacaccttgagctttaaaaaatacgtcttcaacttttaagaaaacatcttcaggcttttaaaaaacaactatacgtttttaaaacacgccagcttgttcagtgcacagacttagcctgttcagcttacagacctagtctgttccgtgtattactcccccactaatccgatacgctcccttttcccctcatcctgtcatcttatgtaatatgcacagaaaatcagccggttaaatctgaaaccatttcccctcacttccatttcagcccgtatcgttttattccttcacaaaaaatgtgaaagagcaggctgaaaggaggctgacagagcaatgacaggagccccttcatagccggaacgcctatgggcagggagtttcagcgatagatgaaaggagaaaaggaacaaccggattttatcgctgaggcatttaaaatgaagataatctcagcatttccacctgcgaatgaacagatgatcatccatgttttgagcctgatttatgattggtatgaaagatttatatctttcaggctatgtaacaataatcctcccggtatttctatactcaagataaattatatcacaattcttgctgctccaaacagaaggtatatttgcaaaatatacaaatgatgcttccggcaacggagtaattctttcttcgctttctttttaggaattcatctaacgaacaattttattatatgcaaaacaattgcgaggcctgtttatgaaacatgtgttgatattaaaatagtaattactgtggaaaatcaactgtcatccaacacattaaaaacacattaaccaatgccactataatagcattacatgatttctattatctatatgtactaaaacaatatattctgttagaaaatctgaccagtaaaaaagaatattcatctcctgaaagccgagttctgttccaattattaaataaaatattaagctaattcaatttaatagaaggtgtgtcgtaatgcacgatgcacctcttttttgttcatcactatacaaatctgttcattttctttaagctgcgatcttttgaagatttctttgatttatgtgttcccagcatccaattggagatgaaacaaaagaggccatctcaactctattttgagacagcctcttgtaaaagcatgatgattgtctgacaataatcctgttcgtatttttacttacttgctttcagcttatcctgtaattccggtcggggaactcccaactctattgctttttcaaaagcaacatacgcttctctttttttcttctgacttaaataaatctcaccacacatcacataaatttccgcatcgtccggtgccagtttggcggcctcctccaaatccaataaagccaaatcaggcgtattcatttctacagccaatgtagcgcgagctttcaaataagaaacatctctgggattatcggaaaccaatttgttaaaatcttctaaagattcacgatacttcaactccttctgatttaaaagtgccctgcccaaacgtgcagtattattccccggttcctcctgtaataaagtattataatctattctcgctcccttataatccctacgttgcatataaatataagcccggaaaagtaacgcttccttatttgtcttatctatatcaatcacattgcaataatccacataagccctgtcaaacaaatttttctccaaatagagtgaagcacgattgagcaatgtaacaacagaatatggagtaatattcaaggataacgtgtacgaatcaatagcatcatctattttccccaatctccgctggaccgttcctagattagtaaacaataaagcattacgcatattggcaggatccatcttcaatgcctgtttgaacaaaatttctgattttgtcaaactgtcgttttttgccgcatccaacgcacaggttatcagctcatcgtaagtttgcgcctgcaactgcatacatgcacatagcaacataagataacatacgatctgtttcatccgattttctatattaattaattccggttgcaaaggtagaggaatctttaacgatattcctttagtttaattaaaaaaagcataaggtaggtttctcgttttaaagggtattccgtatatttggcatacaattttaaaagaataaagaacatgaaagtagaaaaagcgatattcgccgccggatgcttctggggcgtacaacatcagttcgaacgtattccgggtgtactaaacactacagtcggttatacaggtggtccggaagccaaccccacatatactcaggtaaaagcccacatgacccaccatgtagaagctatttttgtagattatgacgccgacatggtttcttatgtggatttgtgcaaacttttttttgaaatacatgatccttcacaaaccgatggaataggtcccgacctcggaccgcaatatcggagtatgattttctacatggatgaaaaacaaaaatccgaagctgaagaggtcatcgaactgcttcgctcgaaaggtcatagagtcaataccaaattacgccctgccgagaaattttgggaagcagaagactatcatcagcactattacgataaaacgggaggagaaccttactgtcatatacgcgtaaaaaaattctaaattaaacaacagaggtgtgttcaaataatggcacacctctgttattcataattatccggaacctttcatcatttcatcaatgcgtccagatacatataaaattcgggattctcgccaactacctgtttagcaattttcccttcaggatcaatcacatatttagtgggataaccacttactccatacatcaccgccacatccggttcacctatattgcgtacattaatccacggcaattgatgctcagctactgcttttttccatttatcctctgtatcattgcagtcaatccctacaaattctatttttcccttgtatttttcatatgcctttttcatttcgggaattccttttatgcaccatccacaccagcttccccagaaatcaagcactacatatttacctctcagagaagataagtcaaaattctttccatccaaatccttcaaagtaaattccggagcaggattacctggtttcattgcttcttttgctttatcgcgagccagttctttctcatatccttctctcattctctgatataaaggagccatcattccttcctttacccggtcagtcaaaacattaaaagcatcccccaactggtcccttgtcaactgtgacattacatatactgatacatctttatccggattctgcctaacatagtcactttttatttttaaaatatttccataccattcttttgctgaagcataaactttacggatagaatctccgggtattccttttttctccatatccatacagactacattcaatgaatctattttatgactatatgctttacagtcctccaacacttcattataatcatcataaaaggaacctccctccaatttatattcatccaatgaacctgaaatttttataggttggccaggcaacagcaaaaaatttacagctttcatcgatatggcaggtatactgccatcctcattgggtttcactgacggtttaccataaatataaacctgtttcaatacactatcacctaaattaaaagcaaaacttccattttgcatggcaatcgtatctgtcctacgactatcacgatcatttacaggaaaagattgtaccaataatgtatcactctcgataccagtcagcataccgctgatttccggttggtccgaaggctggcaggcaatcataaaaccagctcctaccaaagcataaactaaattcttcatctgaatgtctttcaattattatctttgttttatttgcagcatcaaatatactttttcttatccaataaaaataaagaatcagaagtaaaatggcattcacttctgattctccgtaaaaaacctataaaattctatgctttcttgatataatccacaatccaggaacccacttccttagtaccatacttggccccaccttcaacctgaatttccggagtacgcacattttcatccaaagaagcatctacagccttacgaatcaaggtgccttcctccttaagatcaaaatactcaaacagcatggccaccgataggatttgagccaatggattggcaatattcaatcctttagcctgtggccatgaaccgtgaataggttcgaataccggagtgctttcacccgtagaagcagaaggaagtaatcccatagagccactgataacagagccttcatctgtcagaatatcaccaaatgtattctcagtcaccatcacgtcaaagaaacaaggatcctgaagcatcttcatggcagcattatccacaaacatatagtctgtagtcacttccggatactgaggagccatctcttgtgcaatctgcctccacagacgtgaagatgccagcacatttgccttatcaactacagtaagatgcttacggcgcttcatggcatattcaaaagccacttttaaaatacgctcaatctccggacgggtatacatattggtatcatatgccttatcattatcctgatatttttcaccgaagtacatccctccggtcagttcacgaatacagataaaatcggcattttccaccaattcggcgcgcaacggagacttatgaaccaagcatttgaaagtctgcacaggacggatattggcaaacaaacctaattttttacgcatagccagcaaaccttgctccggacgaacctttgctgtaggatcattatcaaatttagggtcgcctacagccgagaaaagcactgcatcggcattcttacaagcctgaaaagtagcttcgggaaacggatcacctactttatctatcgcatctgcaccacagatcgcgtattcataacttactttatggccaaacttctcacaaacagcgttcatcacatcaacgccttgcactgaaatctccggtccgataccgtcaccggctaaaactgcaattttaaaatccatttttttagtgattaatggttagcggtcagtgattaatagttggcggttaatgaaatctgacgacactgttcattaaccactaaccactaatcactaaccattattattttcatattcattttctattatattcagcattttcatggtagccttgatagcagcctccgtctggtcagcatccagcccacgagtacggaatactttttcttcaaaactccaagttattactgtttgcacaaatgcatctgtacggcccccaggaggaatacttaccgcataattggtcaacatagggaatttacgccctaacgtcactttataaattttacgcaatgcacgcacaaaagcgtcatactgaccgtcaccgctggaattctcctcaaactcttttccgttaatctctatttttacagtagccatcggcttcaatccatgcgccagtgtcacaatataacttttcagttttacactttcgcttaccactccatgcttcagcacatcggaaacaatataaggcaaatcttcctgagtaaccaattccttcttgtcacccagttcgataatacgttccgttaccttacgcatggattcttcatctaaatcaagtcccaaatcctccagatttttacggatattggctttgccactagtcttgcccaacgcatactcacgtttacgtccgaatcgttccggcaacaaatcattgcaataaagattattcttattatcaccgtcggcatgaacgccggccacttgcgtaaacacattctcacccacaatcggcttgttggcaggaataacaataccagaataggattccaccactcggctcacatcattcagacggctttcgtcgatattggtcaaagcattaaaatgatccttcagaatagcttgaacactggcaagcggtgcatttcctgcacgttcccctaatccattgatagtagtatgaagtcctttaaccccactcagcacagcagcaagtacattactcacagccaagtcataatcattatgcgcatggaaatcaaaatgagtatgaggataacgttttttcatcttccgcatgaattcaatcacttgcaaaggattcaagatacccaatgtatccggtaacatatatcgcttgatgctggtatccttcaatccgtccatcaactggaatacatagtcagaagaatccttcattccgttactccaatcttccagatatacattaactgcaatatccagttcatcggcataacgcaccacattcacaatatcttcaatatgttcttcaggtgttttcttcaactgctgtgtacaatgtttcaacgaacctttacacaataagttaattaccctgcatcctgtacgttgtatccaatctacagaagtacggccatccacaaatccgagcacctccactttgtgaagcaaattccggcgggcagcccagtcacatatcattttaacagcttcaaattcgccatccgatacacgggccgaggcaacctctaccctgtctacctttaaatcttccaatagcaatcgggcaatcatcaatttttcatggggcacaaaagatactccgctggtttgttcaccatcgcggagtgttgtatccatgatttctattttgacgctttttcccatgcttctatcttgtctttgttggtcagcaaaaagtcgatatcatccaatccgttcatcaaacaatgtttcttgtatgcattaatttcaaaatgttcgcttttacctgtagccttattggttatagtctgttcgggcagatttacttccacttccattttcggatctgcatgaattgaatcaaaaagttccttcaaaaattcttcactcaccaccaccggaagtacaaaattatttaattcattattcttatgaatatcagcaaagaaactggacacaactacccggaaaccatatccggcgatagcccatgctgcatgttcacggctggaaccagagccgaaattctttcccgctacaaggatttgtccaccataagtaggattattcaatacaaaatccttgttcagagaaccatccggattgtagcgccagtcacggaacagattatcaccaaagaatttctcttcacgagttgtcgcctttaagaaacgagccggaataatttggtctgtgtccacattctctaaaggaaggggtacgcaagtgcttgttatgatattgaatttctgtttcattgtcttcgcatttttaaattagttctctaggatctgttattacaccggtcaccgccgccgcagcagctaccagcggactggcaagcaacgtgcgagcacccggtccctggcgtccttcaaaattacggttactagtagataccgaatattttccagccggaatcttatcatcattcatagccagacaagcagaacatcccggttgacggatggcaaaacctgcctcctccaagattttgtccaaaccttcttcacgaatctgtgcatctaccatccatgatcccggaaccagccatgcagtcacatgatctgctttctttttccctcttactaaagaggtaaaggcgcggaagtcctcaattcgtccgttagtgcaagcacccaaaaatacataatcaattttcttacctagcaaggattcgcccggctgaaagcccatatagtccaaagactttttaaaagaagcacttttatcatctaccggaatatgctcagtgattcccatacccattcctggattcgttccgtatgtaatcatcggctgaatatctgctgcatcaaaacgaatttctttatcaaatacagcatcatcatcactctttaatgttttccaatgagacaccgctttatcccaatccacacctttcggagcatgttccctgccttttatatattcaaaagtcacttcatcaggagcaaccatgccaccacgtgcccccatttcaatactcagattacataaagtcagacgaccttccatactcaagttacggacagccgaaccggcatattccacgaagaatccagtagcaccactggttgtcatcttagacatcatatagagagccatgtctttcgccgtcactcctttacccagttcaccatcaatagtgatacgcatggttttcggacgagattgtaagatacattgtgaagccaacaccatttctacttcactggttccaataccgaaagcaacagctcccatcgcaccatgggtagaagtatgcgagtcaccacaaacaattgtcatccccggcaaagtcagccctctttccggacctactacatgaataataccatttcttttatccatcataccgaaatgagccaagccgaaatctttggcattctttgccaaagtatctacctgtgttttagaaaccggatcctcaatcggtttatcctggtcatgtgtcggagtattgtgatccggcatacaatatacatgatccggacgaaagactttcaccccgcgtgcgcgcagtcccgcaaaagcctgcggactagttacttcatgacaataaagcctgtctatataaagttgagtaggtccctcctcaaccttttgtaccacatgggcgtcccaaatcttatcaaataatgtgttagccatttttgtattacgtattattatcttttaaacttgttgatacaatcaatatatgcttctactgatgcagcgataatatctgtattcgctccgaaaccatagtacatctgtccgtcatattccacctgcatatgtactttacccatatcatcactacctttactgatagcctggatcgtaaattccttcaacaccatgtggcggtcaataatttttttcaaagccttgatagcagcatctaccggtccatttccactggcagcagcttcaaagtgctctcctgcaatattcagtcctaaacttgccaccgaacgaacgcccactccgcttgttacctgcaagtaatccaattttatatggttattaacacttctatcggcacctgccaataccaaaatatcatcatccgtgatatctttcttcttatcagccagttttaagaaatcctcatataccttatccaatttgtcctgttccagttctactcccaaaacatgaagacgatgttttaacgcagcacgtccgctacgagcagtcaaaacaatagcattatcatcaatgcccacatccttcgggtcgataatttcgtatgtttgtacgttttttaaaacaccatcttgatggataccggatgaatgtgcaaaagcattgcgtcccacaattgccttgttcggctgaaccggcatattcatcaaacttgataccatacgactagtcggataaatcttctgggtattgatgtttgtctgaatattaatatcattatggcatttgacaatcattgccacctcttccaaggaagtgttaccggcacgttctccaatgccattgatagtcacttctacctgacgtgctccatttaacacaccactaatcgtattggcagtagccatacccaaatcattatgacaatgagtagaaataatagccttatcgataccatctacatgatctaccaaatatttaattttcgccccatactcttcaggcaagcaataacctgtagtatcaggtatattcaccactgtcgctcccgctttaataacagcttctaccacacgagccaagtattcattatccgtacgtcctgcatcttccgcataaaattccacatcatctacataacgacgtgcatatttcacagcagccacagcacgttcaataatttcttcacgagtagaattgaatttatatttgatatgagaatctgaagttccaatgccagtatggatacgtttgtgcttggcaaacttcaatgcgtcagcagctacgtcgatatctttttcaactgcacgagtcagcgcacaaatggttggccaagtaacagccttagaaatttcaattactgaattgaaatcacccggacttgaaataggaaatcctgcctcaatcacatccactcccaaagcttccaactgcttagccacctgaatcttttccactgtattcaactgacatcccggaacctgttcgccatcacgaagagtggtatcaaaaataaataatctgtcactcataaatttcaattttatattttactattattatattcataaaaaaaacctttcacacagggaagtgagaaaggctttcgtatatcattgttcacacatacttttatgcacaacactcacttcccgctgactttgccagtagaataataatgccgcatagcaaaatatgtataaatccttggttcattgtttatctcttattttatctaaaacgttgcaaaggtagagattattttctaaacgcaaaataaaaatgaaagttttttcattatataaactacgattttttatttattctacttttagagtaacagtttataggaatatatatctacaagtatctctatagaagtgtatctgcaaagatatagatcactttagatatagaagcaaattgaatactcactttatgaacatctccccctacagagcaaaacttccggacctgcccctgccggagaaaagacatggcggagccttccagacagttccgtgggaaacgtatccacacccacgggaaagataaggtttttaactatatggtggcgcaattttcaactggaatattggcgcacttttcaattagtatctacagcccaaactagaatgcattccgttgccataggcgtaatcaatggatttatccctgccaaacatagcataggacagatacggtcccgcattgatgcgcaaattccatttgttattcaaagcaacattataagaagcaaggataggaagctccaaattgaatttactaaaaaaagaatcggtaccaagtcttgtcttggatctgaattcttcataagtaaataataattgtggttgtacataccatgagtttttaacatgaacgtcatacattcctccggcataaccgcccaggctgaagcgtgcatccctggacagagatttagaaaaaagtccgcctcctacaataccccagctattctgtgcggaagcgggaagaataaagcaggctaaaagcatgcaaagtagaatttgttttattttcatcgggtttgttgcttaagtttaataatgcaaagtaaggtataaagcccttttcatgaaaataaaacagataacatttaccgcatataaaactttgataataaacaatataacactattaaagataacattcggagaaatttcactcctattgggcatagggacaggtctaaaacctgcccctacacagcaagagaaaagaaatatcttttattgcgtgcaatttatattccgcaacttccctctgaacccattctgcacatccccaatctgccgcatgggaaacaccaaagtttcctgcatatacatcttgtccttgcgtttatgagtatagttgtaaaactgcttgatacgtccttccaaacgttccgctttctcaccgtttatgtaaagagtagtacctttgtggtctccctctatgcgtaccttcgtccatgctccggcaggcagtgtggcagcgtggaatacaaacgtatagccgtcacggctgaaagccaattttcccttattttcccaattggcatatacggtggaatgaggacctttaaacaaaataccgttgatattttggtctttgtccggatttatttcaaattctaccacgtatggatagcctacctccggcaacatagtggcaatgctgtccgtaccgttcaaagacagttcttcattctgccccggaaggactacctcaccctgcacacgccccagcaggttgacaccgggagcttcaggcatctgtttgcacaattcctcaaattcctcgtaagaaaccatttcattcttccctctccacatcttctcggccagtacctgagcggccgggaatgtacggaaatgcacatcctgttgtgacacaccgttaccacaatggtcattccatacggcaaacatacctcccaacagtcccggagttccttcaggcaactcttccttaggattcactttacccacacgccattgctcatacagccatttcgtgtccaggaaatcacgataatatccggcagccggaacaatataaagataagcatcacacgtattgataatcttatatccgtctttcaaagaagcattaggatcaatccaatcgtatgaccaggcattaatagttacattatccgctttcaccggagtgtttcctttcaaccagcgcagtgctccccacatacggacattcttcccgtatttctctacatacttcagataccgatctgtaaaatagcggaatttctcagcttccttggcattgtactcgtctgtaccgatatgtacgtcgggacctatgaaaaccggtttctcaccagaaagatactcatccagcaaagaatctacaaaacgataggtttcctccttgtacaaatccaaatgatccattccatatttatcactgcctatctcgggtttataatgtgtaaaggccaatgaatgagccggaatatcaatctccggaatcacattcacaccatattccatgcccagacgttgcaggtcggtgaattctttcttggtataagaaccatccttggcggtcagccccggaaaacgctcactttccaggcggaaagcagcataggtcttgttccagtcgttatcaaagaactgtacaaaaccattgtcattgagatgaatctggaattcattcagtttatagaacgatagtattttgacatattgccgcaggaaatccattgtgaagaacttacggcccacatccagcatgaagccacgactgggatattgcggccagtcacgggcaactcctttgggcaactctcctttttcattataaagaatctgcaacaaactccgggttccccaaaagactccctgacgagccggtgcttcaataccggcatagcgtccggcagtcagcacatacccttcctttcccaattgtttgtcgggtttcatcaatgaaagataaatatcattctttcccggtttcccggtcctaatggtgtagttccaatccaacagatctttcaagtcctgtgccagcacagtcgccacacttttcagtgccgcctcatcggcaggagctacaacaatactgccttcagcaggcaatacgagttttccacttccccccttccactcttgcagggcgggaattactttcggacatgtttccttggccgaaacacacagacacaaggccaacatccataaggttagtaagtgtttcatgataatgattaatggttagtaattaacggttaatgaaaaatgaaggcatttatttgccttttactatcttcttgatatcattcagtttattcaatgcttcaagaggggtcagattattgacatccaaattcagaatctcatcccgtatctgactcaataccggatcatccaactggaagaagctgagctgcattccgctccggccggacgctatctcagccgtaggcttggcaatgccctgctggcggttgtccgtttccagttgatgcagaatatcattggcacgcttcacgatgcttttcggcatacctgccatctttgccacatgaataccgaaagaatgttcgctgccgccacgttccagtttgcgcagaaaaatcactttattatctatctccttcacagatacattgtaattcttgatgcgcttgaaagatttctccatctcgttcaactcatgataatgagtggcaaacagcgtacgtgccttggctttaggatgctcgtgaatatgctccacaatagcccaagcaatggaaataccatcataagtggaggttccccgtcccaactcatcaaacagcaccaaactacggctagagaggttgttcaaaatatttgccgcctcattcatttcaaccataaaggtagattcgcccacagaaatgttatcgctggctcccacacgggtgaatattttatccaccataccgatccgcgcactttcggcaggaacaaaactacccatctgcgccaacaaggtaatcagcgcagtctggcgtagcaaagccgacttacccgccatattgggaccggtaatgataatgatttgctgggtttccgagtccagaaagacatcattggcaatatacttctcccctaccggaagctgcttctcgatgacaggatgacggccttgcctgatgtcaatcacctcactgtcctccacaacaggacggatataattgttctctttcgccacattggcaaaagccagcagacaatccaatcgggcaatctgactggcattaatctgaatggctggaataaactctgccaaagcgatcaccaattcattatagagctttgtttcaagcactaaaatcttatcttcggcccccaagatcttttcttcgtattctttcagttcctgagtaatatagcgttccgcattcaccagcgtctgtttacggatccagtcggcaggtaccttgtccttatgcgtgttacgcacctcaatatagtaaccgaacacattgttataagcaattttcaagctgggaatgccggtcagctcactttcacgttgctgtactttgagcagataatccttgccggaaaaagctatctgccgcagttcgtccagttccgcattcaccccgtctgctatcacaccgcctttattcaccagcaaaggaggatcattcttaacctctttcgctatcttttcacggatagacagacatatattcagttgttccccaatacggcggagactcccgttatccgcattcaaacaggcattcttaatcggctcgatggcttgcaaagctactttaagttgcaccacctcgcgtggagagattcgtcctacggcagctttcgaaacaatacgttccaaatctcctatcagatgtagtttctcttctatgaactctttgaaatccggcttgcggaagaagtattccactacatccagacgctcattgacaggcttctcatctttcaacggaaagactacccagcgttttagcagacgggctcccatagggctgatagtgcggtcgatcacatccagcagactggttccgccctcattcatgctacctatgagttccaagctccgtaccgtgaatttatccagccgcacataacggtcttcctctatacgggaaagagaagttatatggccgatctgataatgctgcgtcatattgaggtattgcaaaatagcgcccgaagctacaataccattcttaaggtgctccaccccgaaaccttttaagttcttggtctcaaagtgcttcaacagcttctcgcgtgaggaactttcattaaacacccagtcatccaactcaaaagtaaagaacttgcttccaaaatttccttcaaacattccccgtttaccacgttcgaaaagcacctctttgggggcgaaattatttaataacttgtctatatagtcaaaaggcccctctgcggtaaggaactcaccggtagagatatcaaggaaggccacaccacaactggctttcccaaaatgaacggcagccagaaaattattttctttgtaagaaagaacattgtcattgatggctacacccggagtcaccaattcggtgataccgcgctttaccagtttcttggtcatcttgggatcttccaattggtcacaaatggccacccgcttgccggcacgtaccagcttgggcaaatacgtgtccaatgcatggaaaggaaagccggccatttctacgctctttgcctgtccattggcccgcttggtcagcgtaatacccaaaatctctgaggcaacaatagcgtcttctgaataagtttcataaaaatccccgcacctgaatagcataatcgcatcgggatgctttgccttcaactcaaaaaactgcttcatcatcggggttaaaactacatcatttgccactgtatcgtcctttctttttttaattaatatttctcgcaaagatactaattagcaaatttaatctgaaacagtaaaagaaaaaaattatatctttgtactagctaaaaatacggaaacaatgaaagaaataaaagtaaacgaactgactgacaatctgtttgagacaatcagcaaggaatggatgttggtaaccgccggtaccaaagacaaattcaacaccatgacggcaaactggggaggtgcaggatttctatggaaccgtccggtagcctttatctttatccgccccgagcgttatacattcgactttatagagcagaatgactatctcactctctcttttctaggtgaagagcataaagaagtacataagatatgcggttccaaatcgggacgtgacatggataaagtaaaagcgacaggactatcgcccttgttcaccgagaacggaagcatcacttttgagcaggcgcggttgacttttgaatgcaagaaactgtatgccgatctgatcaagcccggaaactttatcgacaagagcattacggaccgatggtatggggaatcacacggtggttttcacaagatgtatgtggtggaaattgtaaatgtgctaagccgctaattaacggcatcgattgtttttttactgctgcttcttgtattgactatattaaaggatatgatccgatacgaaaaaagcccgtcaaactgtatgtttaacgggcttttgtttcatttcggattgaaaactgttggactaccaagattcgaacttggacaaacagaaccaaaacctgttgtgctaccattacaccatagtccaatcattatgtgctttccttagaaagcggtgcaaagatacgtttttcctgcaatatattccaaatattttcgcacttttttttgcaataaagtgcaaatgcttaactttgcgtacaaactaaaagaaataaatacatgaaaaaacttctaacttgccttgctttaagccttgttgcagcaagcagttatgcagctacacctttatggctgcgtgacgtgcaaatttcccccgacggcacggaaattgcattctgttataaaggagatatctataaagtaccctccaacggaggaactgccacccaactcactacacaagcctcatacgagtgcagccccatctggtcaccggatagtaaacagattgccttcgccagtgaccgcaatggcaatttcgacctgttcgtcatgtcggccgatggcggagcagcccggcgccttaccacccattcggcttccgaaataccgtcaaccttcaccaccgacggcaactatatcctgttctcggcctctatccaagaccctgccaacagtgccttgttccctacctcggccatgacagaactatacaaagtcccggtaaccggcggacgtaccgaacaggtgctgggtactcccgcagaaatggtctgctttgacaaatcaggaaaaacatttctctaccaagaccgcaaaggttttgaagacgaatggcgcaaacaccacacctcgtccatcacccgtgacgtatggttatatgattcggaaaacggcaagcataccaacctgaccgcccatgcaggcgaagaccgtaaccctgtatttgcgcccgacgggcaaaccgtttatttcctgagcgaacgagacggaggtacattcaacgtatattcctttccgataagtagtcctcaatcattgaaaacggtcacccatttcaagacccatccggtccgcttcctgtcaatgggcagcaacggcactctctgttatacgtatgatggagaaatatacactcaaaaacaaggagataaaccgcagaaagtcaaaatcgatatcatccgtgatgaccaaaatacaatagcggatctgaatttcagtaacggagcaacctcagctaccgtatcaccggacggcaaacaagttgctttcattgtacgaggtgaagtattcgtcacttccgccgattataataccaccaagcaaatcacacatacccctgcccgtgaagcaggacttactttctcaccggacaaccgtactttggcgtacgccagtgaacgcaacggaaactgggaactttacatggccaagattgcacgtaaggaggaatccaacttccccaatgcgactgccattgaagaagaagtactcctgccttcggacaagacagaacgtacctatccgcaattctcgccggatgggaaggaactagcctttatagaagaccgtaaccggttgatggtgcttaatctggaaaccaaaaaagtacgtcaggtcactgacggttccacctggttcagtaccggcggtggctttgactattcatggtcgccggacggcaaatggttcacattggaatttatcggaaaccggcatgatccatattccgatataggtatggtaagtgcacaaggaggaaaaattatcaatctgaccaatagcggctataccagtggcttcccccgctgggtactggatggtaatgccattttattcattaccgagcgttatggtatgcgtgcccatgcctcatggggatcactgaacgatgtgatgctggtatttatgaaccaggatgcatacgacaaattccgcctgagcaaagaagattacgaattgcagaaagaactggaaaaagaacaaaagaacacaaccgaagccaagaaaaacgataaaaagaaaggtgataacaaagaaaaatccgaagagaagaaagaggaaaaagtaaaggacattgtggtggaactgaacaacatagaggaccgcatcgtacgccttactcccaactcttccgatttggggagcgccattatcaccaaagacggcgagaccttatattacctctctgcctttgaaggcggctatgacctgtggaaaatgaatctgcgcaagaaagataccaagttgctccataaaatggatgccggatgggccaacatggaaatggacaaggatggaaagaacttgttcttgctaggcagtaacacgatgcagaaaatgggtactgattctgaaagtttgaagcccatcagctatcaagcccacgtgaaaatggacctcgcagccgaacgtgactatatgttcaaccatgtatacaaacaagaacagaaacgcttctacaacctgaacatgcacggaatagactgggatgccatgaccaaagcctatcgcaagttcctgccgcatatcgataataattatgactttgcggaattactgagcgaatatctgggtgaactgaacgtttcacataccggaggacgtttccgtccgcaactgaaaggagatgccaccgctaccttaggattactgtatgactggaatcataacggcaaaggtctgttgatttctgaagtagtggaaaaaggccccttcgaccacgcccgttccaaagtgaaggccggaaatatcattgaaaagatcgacggtcaggaaatcactcccgaaagcgattactctgttctgctgaacggtaaagccagaaagaaaacactggttacgctctataacccgcagaccaaagaacgttgggaagaagtagttgttcctgtcagcaatggtgtaatgagcgatctgctctatgcacgctgggtaaaacaacgggcagccgatgtagacaaatggtcgaacggccgtttgggatatgtgcacattgaatccatgggagatgacagcttccgttccgtttattcggatattctgggcaagtacaataaccgtgaaggtatcgtcatcgatacccgtttcaatggcggaggacgtttgcacgaggatattgagatcctgttcagcggaaagaaatactttacacaagtagttcgcggacgtgaagcttgcgatatgcccagccgccgttggaacaagccgagtatcatggtgcagtgtgaagccaactacagtaacgcacacggcactccgtgggtatacagccatcaaaaaataggcaagctggtaggtatgcctgtaccgggaaccatgaccagcgtatcttgggaaacattgcaggatccgacactggtattcggcattcctgttatcggctatcgcttgccggatggaagttatctggaaaattcacaattagagccggatatcaaagtggccaattcaccggaaacagtagtgaaaggtgaagacacacaattgaaagctgcggtagacgagctgttgaaagagatagacggaaaataagacgaaagaaaagatacaaacaagggatattcagtaaatgtctctaaaaaataagatggcatatgaagatgataggaacttctcttttctggtttgcccataatcagccgcatagcggatgactacgggcaaaccgggaatgagaacagtcattccgatgaaggggagggtggggaagaatactgcgtgaacgcaaaaacactctcggatatgtagcaaaaaaaagcggcactaggccgcttcaatcatttgcttgcttttttctttttagagacagccttctgtttaggctgatccggtttttcttcttctttttccggagccggataaaacttggtggctaccatcacaatgcggttacgcttctccccacttttagaatccgtccattcttccggcttaaagtagccttcaacggttatcagctcaccttttttcaatacatcgaaggaatccagtgcttcattctttctccaggcttcaatccccatgaaagcggaaacataagaggtttcttcacctgtcttgtctgcacggctgaccgcgatagaaaagcgtgctacgcttgctgtttcaaaactacggatttctgcatccttaccgataaaacctgttactgcgaatgaattttcaatctttttcatatctctgattttttagaagttaattaatcaattttacagtgcaataactgattgttggctttgggggacaccatgaaaaaagatataaatactctttttatgctggccggaaaaaggaagatttgtaacttttttattggtgaagatggcagcaaataattcgggttaaatacgctttttatgcaaggcaaaaaaaggaagatttcagacgaataacaacgtggtgtttgtgaatcgtccccttatccccgtaaaaggggttagcaacaatctatatttgcaacggaaaatgatttgacttccctaaaaaatgatatgaaaaagacaaaacttgaaaatcagcaacaggtttggaaaggatgcaaaaaacaaccggtcagacagcaagcatggcacattccgaaaatatggtcagccgcctatcgacacaccggaagaaacctctgcaattccttttaaaaaaatgaagccgaagaatgaagcatacaatattccacgtatcgaaaaaagtgactgcacgataaaatgaaaggctgcaacggaagaacagacttgcggattctgcggggagaacataaccatacaggcatacagccactacaactgtttccggaaaaagaagattatacaaccggaaaaacagaaaggcatccactcggagaaaagcaagcaaacgattgaagcggactgccgatttagcggcgaaatatccgactacctatatacagccctaaaaggctggggcatatgggtaagcaacagactgccgggcaaataaaaggagagtggcatagccgccggaaagaggttgtctcgatgtggccgaagctccgaaagcagaccggatatgcctctctcctttgccttccccattcctggatttcacacaatcacggagcctgcgagtgactatgagaaatcctgaaacggggacagtcactccgctgaaagggtgggtgggaaacatgtgactttctccaaaataacaaataggggtataaagatctcaaaagaaaagaaagccgttccagaaaagactggagcaactatcaccatctactgttctttaagttaattgcagcaaatccaaatcatcagtgaccaatccatccaatacatgttggattttatcaaatatagccttatctatgccatacgtggcgcataacgattgaaatttgcttacagcatcgaacacctgtaatatcttcttttcgggctcctctacaaaatcctcggcaaagttgacgaaatcacttgtagtcaaggcagaccttttgcccatcacgcccatcgaatgaatgtgtgctgaagaattttcccatgtatttgccgtgaacattacatcatatgcaggtgataaacgccatacccctgccttatccatgataaacgatatgttcttattatgatcatcggatatacctgcgacataattaaataccattctgataaatatctgatctttgtcttcctggggaagtttcagagtctctgctatccaacacagcttcatataatcatctgcacccggcataatggccgcaagggtctgactaaagagcttttctccattcttacgatcaaatctttccgttacgaaatgatttcttccatcaatttctttcaggaagcatggcatcatgttgattcccgccgcctttgccatttcgctatataccatttctatctctgtggtaggagagtcatctgcttctttaaatttgatgatatactgcttaaaattttcaggcaaatccacctggccggaacgaaactcttccgtttcgagattataggcaatcactgccttcgggcgcatgccaccggcagaagttccaagatatatcaactttttcatcgtgaggctatcctccggtgatatgacagcagcatctcgatcattatatattttagaagccaaagttgccaatgatgacatatttactgactcatggatggcatcatcattaaattccggttcaaattccaatgctcccatagccctcttgccaatataagagagcttcaatagaggcaatgattccgtaacctttatattattatccgtgagccattggtcaaatagggaagccccccatttgtcaggaagcgcatctgcaagaaattccggaagcccttgatataatttatctttattcccatagaaagacgcaaacaaaggggttctcttagggtgtgtggaagggcatatatcataatcttgtttcctatattcatccgtaaattggaatacagaacaatgcttttcaaagtcccaattcaatttgccaatgcaagtcccccacagatatacattcactataatcggctctttcttcataccatcttacgtttaccgttaattctttgtattcttttacctgttttttcattgattaggaaaggggagtctggaagttccggaaccaaaccgacaacgccttcaagagttccacttatacgcaaaatcttaagcaatgtacttagggcaatatcacttactttacaagattctattctcttaatagtaacgatagatactcctgccttatccgcaaattcttgctgggaaaaacagcagctaagtcttatagacttaactctcttgcagatttcctttacaatacattcatctgaaaattcgtatattgtatatgtatcatataatcttttcatagaaaaacatatttaggtatcatttttgatacaaaaataccgataaatctgaaaatcaccaaattaagaaacactttttttataatcttctgccgcattagcaaacgattgaagcgaccttgtgccgcttcaatcgtttgattgctttttctttttagtccgggggttcttatttttccggagtcgggtagaacttagtagctaccatcacaatgcggttacgtttctccccacttttagaatccgtccattcttccggcttaaagtagccttcaacggtaatcagtacatctttttgcagtatccaaaaagcatagcggtcttccatcttactctaggcttcaactttcataacagaggaaacaaatgttttttcttcatttatcttgcctatgcgactgaccacaatagagaagtgtgcaacctttactatttcgaataaatggatttctgcatccctacaaatcctgcctgttactgcgaatgaattttcaatctttttcatatctctgattttttagaagttaattaatcaattttacagtgcaataactgattgttggctttgggggacaccatgaaaaaagatataaatactctttttatgctggccggaaaaaggaagatttgtaacttttttattggtgaagatggcaacgaataattcgggttaaatacgctttttgtgcaaggcaaaaaaaggaagatttcagacgaataacaacgtggtgtttgtgaatcgtccccttatccccgtaaaaggggttagcaacaatctatatttgcaacggaaaatgatttgacttccctaaaaaatgatatgaaaaagacaaaacttgaaaatcagtaacaggtttggaaaggatgcaaaaaacaaccggttagacagcaagcatggcacatcccgaaaagatggtcagccgcctatcgacacaccggaagaaacatctgcaattccttttaaaaaaatgaagccgaagaatgaagcatatcatattccacgtatcgaaaaaagtgactgcacgataaaatgaaaagctgcaacggaagaactgacttgcggattctgcgggagaacataaccacacaggcatacagccactacacctgtttccaataaaagaagattacaccaccggaaaagcagaaaggctccactcggagaaaagcaagcaaacgattgaagcggactgccgatttggcagcgaaatatccaactacctatctacagccctaaaaggctaggacatatgggtaagcaacagactgccgggcagtcactccgctgaaagggtgggtgggaaaaaactaagtggacgcaaaaaacaaccttaccattgggggataaacttccccctattttcacttcacatattctttaccccacttcaattgattcaacaaacttcaacaacaaagcgactgttaccgtatgaaatgaaagctgattgaacaacttatgcgctttcagcatctcaatagcggcttcagccgtaacaactctctgttcataaagccgaattgtcgcatataactggtcatttgcgacaggccccattattaggtcatagtcaccgttttctcttcctctgcggttgttgacaacaaactccagccattcttttgtcgcacccataaaccgaagaaccggatattccctatcaagaatatcatcgggaacttcataaacagagacgattgctttttcgctctgttccctgttcttcttcaacaaagcccatttttttgcttgttcaaagttggttgtcgtataaaatcccttcccaaagtccgtagccttccgtcctttctgtatattagggcgtttcacggtaactgtagatccatgaaatagtctcattttcttttattgatataagtcgttatagtatctaatatatattcggggtcttgggtatgaagcatttcaaaagtctcatccaaaaaatcaaaaaccccatagtccgaaaacaacaacaaggtttcttccgcactttgtttcttttcctccctataattctcaatgcagaacatcttgaaaagcaggatcttcgtgtcaccgttataccgtcgtttttcttctgttttttccttctccaatgtttcataaagcgacaatgtacttgaataccataacttggtactcttatccagcaaagatttatacaacttggaagaatatatataatacagtgcatcgcctaaaggcaatgcctttttcttcatgaccagttctaccagctctctcatcacgaatgggagcatggttgagtcaagttctccttgatttttatgagtaatttccatattcttgttgttattactttagcatattttcgaaaacaccttcttcacagttctttatacacacctgacactcggccaccacttctcttaatattcgggcacattcttcattcgaatgcccttgcagtaattcataggcatatcgcatcagttcattagcttccattgtttccatccttatcaataatattcaagttcatcattattttctgcaacgactccatatttggagttcctaaccaacacacacctatgcaaaaggtcatattgttctctgtatctgaaaaacgcatattgttttaccttttacaaacattgttgtcccattaaaatctaaaagagttctttgaaatatttgaaatttagttagttacagcgattttccgagcgaacggacttgaatttgtagctttgcatcagattaatccgatggcatatgttccaagacaaatacgttttcgctcaattggcttcatttctgaatcgaagtaagtttaaccgcatagtcaccaagtatgatggtgataaatatgtgaagcacttcacctgctggaatcaactacttgctttgatgtttggtcaactttctaatcgtgaaagtctgcgagatttgatagttgctcttgaagctcatcattccaaatgttatcatttaggaatgggtaaaaatgtatcaaagtcatcgctggcaagagcaaatcaagatagagactatcacatctttgaagaatatgcttactacctggttagcgaagcacgacaaaagtgtgctaatcatattttcaaacttggcggtaacgtttatgctttcgattcgactactattgacctgtgcctttcagtcttttggtgggcaaaattccgcaaaaagaaaggtggtatcaaagtgcatacattatatgatgtggaaacacagattcctgcattctttcatatcacggaagcatccgtacacgattctaaagttatgattgaaattccttatgaaccaagctcttattacatctttgaccgcggttataacaacttcaaaatactgtataaaattcatcaaattgaagcctactttgttgtcagagcaaaaaagaatctcgggtacaaatccatccaatggaaacgtaggctgcctaagaatgtgctttcagacgcaagtgtatttctgacaggattctatcctaaacaatattatccagagccacttagattggttaaatattgggatgaagaacaagaacgagaatttacattcataaccaatgcgatgcatatatctgcgcttcaagttgctgaactttataaaaatcgctggcaggtagagctgtttttcaaatggctcaagcagcaccttaaaatcaaaagattttggggaactacagagaatgctgttcgaatacagatatatgctgctatatgcgcttactgtttggtggcaatcattcaacacgatatgcaactgaacagaagtacatatgaagtgttacaaatactgagcatctcattgactgataagactcatctgagagacctctttgataaaactaaatttcaaaatgacaaagaacgattcggaccaaatgggccaagtttatttaatttttaattcgtcccaattttaatgggacactaatgttttacaaaggtaaaacaattaagtaaaattcatctatcattgcttttcatatttattgtgtctttctcttttgcatcggaagtattagcacttacagcaaccagacagtatgacatcgccacgtttgatcataccgctggaaaacaacgatatacaatctgaatcaaaacagattgtatatcaccaatttctttttttgtgccttgttaaacgtataagaagttcctccggcagattttccatcccaataggcaatcagcctacaggcgtgtgaaatcatgtaatcattacggtgggcatagcattgggcataataatattcggatagaactaccaccttgtcggcttggcgcaaaatatcagcatacctctgtttgtcctctttgttgaaatacacatcttgcccgacataaggaacaaccgccaccaaaaccatatcgggatattgtttcctttgttcaagtacggtatgagcagccatcatgtcaaatccaaccgcacaaccaatatagaaaaaacggattccattctcatagcagaaacgtacctcttcattcaacgatacggacaaagcatatttatttgttcgtatcgttctatgaccggtaaaagcaacggacatcattttcatccatttatcacgtgcctttctacatatatccaacgaacctgccgaagtttcatacaccattccattcacctcataacgataagtgaaccaagtagtatctccaaagatatccttctgcttctctatataactctctttttctttcatcttataacatacggacaactgttttacctaaaaagaaacctcccaaaacctcacctcctattttttccaactgacatgcgaaacgagcatacgaaaacccttttgttaaaatatcgtcaaataccaagattttcttaccccgaaaaaagtccttgtcaaattctatcacttgtactttttgaagcgacttgctgtcaaatttctcgtgaatagccaaacgatctccactgacacgtatatgttcatacgcattgatagcacctgaaaacttacacacagccgaagcaaaccccttataacgaagttcattcttatcagcggaagaagccggaacacaagcaaaaacaatattcttaacatcatcaccaaaaacttgatgtaacttattcgctatcatccaagctatattcaaataagcttttccatccttaaaactccatatcatcttacgaatttgccattctctttccgttgcctgccgatattgcataggaagatactcaaagaaagaaaacatcatcttatgccattgtctgtctaaactaggatatttactctgatgtgccatagtcttttatctattaaaattaaacttatgcttcagctagatttaaagacctttttttaaacccctttccgggatggccttttctttctgccgactttttttttgagctttcaggtaaaatccattttgaacggcacgaaaaagacggagaagatttgcacgcccatattatcgtaagccataagaccaagaataacggtaaatcaatcagccccatgacaaaccacacagggaaaaagaatacaggtgcagcacaagggggatttaaccgcaaagagtggtattcttcatgtgaaagggcttttgataaacgttttaaaaatgaacgtgatataaaggaaagttttgaatacaagaacgccatgaagaacggcacaccaaaagaaatgcaggagcagataaacagagccattcagcaggaacggcagagggaacaacaggtacgacagcaacaggaacagagagtaacacaagctgtcaagactgaaaaaagggataataaagtaaaaccaaaattataaaatcatgaaagagggacaattaaaaagtagcaaccgtagcggttgtttgatgtatttggcattgatttacgctttccccatgcttgcagctttggcggttttgcctttgggtgtggtgtatttgtgttttcgtgccggagaaatcggaaacggtttgtttgtgcttgcggtggaagccggagcagtctatttgtttatcaaatacaaacgtaagggaaaaaaagaggaagcccccaagaacccgaatacggcagttttacggacagaagccggaggggtgcagttgggaaacccatttagaggggtttttgtattaggagcagccggaagcgggaaaagtgaaagtattgcagtgcctttgctttccgagtttgtccgcatggggtttgcgggtgtggtatatgatttcaaatttccgacattggcaaaagatgtacaatcctttttaaacgccaaaggaagcgttttaagacacttttatttggatttcaataatccggctgcatcttacagggtaaaccctttaaatccacgatatttgcctaatacgtcttatgcacgtgagtacgcacaggcaataataagcaatctaatgaaagagagtatcaagaagccggacttttggacgagaagcgcaaccgacctcttgaccgcctgtatttggtatctgaaagaggaacgccccgatatttgcgatttaccgcacgttttagccatgataacgagtaatgataccgcactacttaaaactttgcagaagaacgtacaaacggcacaaatgaccgttagtatttacaatgcaatggagaggggggcagacagccaagtaagcggggttattggcacattacaaggagcaatagcacagataaacactcccgaacttatgttcttgttttcgggtgatgatttctcgctcgatgtgaacgacccgcaaaaccctattattttgacagtcggaagctacccgacattaacacagacttttgccccattgtgctctttagtgataacggttgctaccaagctgatgaaccagccggataaacatccgtcttttgttcttttggatgaagcaccgaccgtatttataccaaatatcgaagttttgccgaatacaggcaggagcaacaagatagcaacggttataatgtgccaggatattgcacagttagaggacggttacggcagggaaaaagccgatgttttgtttgcttcctgcaattcccatttctatggcagggtagcaagcagcaaaacggctgaaatcctttctaaacaattcggaaaagccgataaggtatatataacatctaacgagggacgcaatacgaggaagtttggaaaaacttttggtaggtctgaaacaatacaggaacgtgatgttatcaagccgtcagagtttttaaacttgcaggttggagagttcgcagggctggcagttgaaagcaataagcccacgttcagaacccgatttaaacaggcacaaagaccgcaacccgcagaattgaagaagcccgacttttccggctctgtgagcgattattacaagcgggtgagatatgatataaataaaatgcttgaaattggaggaactgccggagagtacgacagagacactatgaagctgaacgaaacaaagagaaatttctttggggttgagtattgaaaacctttatcattttgatagttgctttggtctgaatgggggaagaaccgcccccatcagccaagtactgaatatcattttgtaacacccggcaatactatttctgtggtttgtggttcgatatcgctatctttttgttttttatgatagacttctatttctttttgaagtttggtttccattgcgtcacgttcgggagttcctattttcccccaaacttcatccactaaatcatcagctggtgtgaaattcatttttgccatatctgtttttaataaaagttgggtttttgtccctatctcatagcgttgcatagtatgctttcaatttgggtgcataatagttttgtatcttatccatgaccgataagcgtacattttcagaaacttcaaactgcaagagtccgtttgctattttttcttctgtggtaagcatatccaattctttgtataattgggcgtgtttagctttatctgtttctgctgtaatttctttcattttcatcatgcggagcgtcccgataatatcaagtgcaacatccaaactcatttctttattcatggttcattatagttttatgatttatacttcaatagatactgtgaattttaataatggaataactttcactgtatgaaatgaaagttggttaaaaagcttatgggtctttagcatttcaatcgctgcatcagccgtaacaacaccttgttcataaagccggattgttgcatataactggtcattggcaacgggtcccattattaaatcatagctgttttttccttttcctctgcggttattaactacaaactccagccactcttttgtagcaccctcaaaccgaaggactgaaaactctctatcaagaatattatcggggacttcataaactgaaacgacagcttttttaccatgttcccgattccttttgagtattgcccacttcttagcctgttcaaaattagttgtcgtataaaatccttttccaaagtcagtagctttacgccctttctgtatattaggggatttgacggtaactgttgagccgtgatatagtttcatacctttttattgatataagttattatagtatctaatatatactctgtatcttgtgtgtgcagcatttcaaaattttcatatagaaattcaaaaacgccatgattggaaaacagcaaaagagtttctttagcacttatatttttagtttccctataattttcagcacaaaacatttgaaaaagcaatatctttggattgtccttttgtactctcttctgttctgttttctctttctctaatgcttcataaagtgataatgtacttgaataccacagttttgtattctcgtccaataatgccttgtacaaattggaagaatatatatagtataacgcatcttctaaaggtagcgtttttcttttcatgactgtatcaaccaattctctcataacaaatgggagcatagccgaaccaagttcattttgatatgtttgattagtttccataactattgaatttaatgtttgaaaagttgtttttttgtccccatctcatagcgtttcatagtatgcctttaatttgggtgcgtaatagttttgtatcttatccatgactgataagcgcacattttcagaaacttcaaactgcaacaatccatttgctattttttcttctgtgttgagaacagaaagttctttttgcagtattttttttctgttttcatccttttcttctgatatttcatctattttcatcatgcggagtgtcccgataatatcaagggcaacatccaagctcatttctttattcataaatctgtatttacttttattttccctaaagttttttgctcaatctgaacccttacaagttctttatgtgctttttcgtaccgttcacgcagagccttgttttcttcccgaagctgttgcaactccttttctaaaaaatcggctcttactttttcttcggtagctttggcgatgatatccggttctggtagttgtgcctgtttttgcgagattataaattcgctcatcagcttacaaagcgcatccacttggttacgctctctttctacttcagccggaacaggcagaaagggggttacttcagtatcgtaaatatcgaaatcgttcttttgcaagaaattccatgccttttccacccattccccaacaggttgccccgctttacggcaatatatttttatatcttcaagcacgtttttaggcactctaatggtgcttgtttgtatatcgctcatgtatctatatgttaattagttatatgcaaaaatataaagaatatatttagctttctacaaaatctacaaaaaatatatttatatctttctgtcaatatcaaagcatagagcattgatgttactttcggtagtccatacggctatttttcgaccgtcaatttcaacgataacacgaatgaagtcgttaccttgtggttgttccttttcttgtgaaacttctacaaccttaacttttagttcttccatatctattttattttttgtcatttagtttaccttttattgaattaatgatatagcctttagggttcttcttgtctcttgctttgccttttagtaaagcaagttcacccattaaatccggaagtatattttgtgcagatatgaataaatccaagttattcttaatttctttgtctgaatatcctattgagttttttaggtaattgcgaacttctgatgataaagaccaacttaaagaaatttgcttttgcaaatcgtgtttttccaaatcactatctcggtgctccggctgatatacaggataaaactttatggcggtaatctttcttcccgatttgatgggggtgtattcaaatgtatatgggcttacttcatccaactctttttttgcagcttccactacatagcgtataaaatcgtttatacgctcgtacttatctgctacacaaaacatttctttcagttgaattactgaataggttagggggcttttttgattgctaagtagttcatagaagcgcatggaaaattggcttttaaaactcatggcagcctttagctcatattttcggtagcctttggaaaaatcaagaatacagtcccatacacgagggtggacttgaaaagagaggacagaggaacgctttcggatataaggtagtgcgataatagaaatgctttgccaaatttcatcatcttcatattcgaatattttccgttggagtgattgcaaggcttcctttacccttgcatagtttttatcttcttctccattgagcaggcaagcgataggcatggttatgtttacgcagctgaaaaggtcatgctctattttctggcagttattggcgaattttacaccttgtacttctccttgagccatttctacaagacggtagattattcgtttttcgtacacgttaaagtcatatttggcggtagtcataatataactttgaataaggtctttgtttactattgccatatttatcaatgttttgtgcaaatataaaatataaaaacgagttttacaaataaaactcgttgatgttgtggaatagtattcaaaaactcgtagtaaaaagatgaaatagtattcaaaaactcgcagttagtattcaagaactcgtagttagctttttatttatcatattaaaacgtttattattagtttgttatatgttgttttctcttgtttgataagcatataacaagttatgccttaaaacaagtcaaaggattttagagaagtgaaaagagagaaaaacgagttcttgaatacttgtggaagcaaagcaaaaagctaagcgcagcgggggaaaggacgaaattccctgcgtgttaaaaaatgtatttttatatgtaattttttgcaattttttttgatttggtagtttaggtacttcttactataactatttgttatacagactgtttacaatactcttccaattctttacaaatgtattctttcaatgttatcccctctttctttgcttgtctttcaaggatattaaagacgtaaaagggtagttctatttcaacagaggtatttttaggtttaaataaatcttcctgcccgaagaacacgtttttatcttctgtttcggcagagatgacgataccaacaaatgggttgttctcaacctctatcactgtcccgcttatccaattcggtaatttggtaaggtcgggagaaattagaactttatctcctgttttcatatagctattttttttgttttcaaagatacatattccccatttacttagctgtttgtacctgttaaattatgcgcagtcggaactattcctattagcccgccacacatccgactgcataacccccgcccccttgtgcattggcgcagctcacgcccgcccgcaccgcaggggaggggtattccgtcggctgcttaggcagtcgaataggaatagcaagaggaaacgccacagagttgcgttttttcctcttgccctacggggttacggctgaaaatcagccgtatataaaaaatcattcgattttttatatatagtattgatatattgtaataaataactacttttgtatcagtacttaatgatatataatccgttataatatggaagaaaaaagacctaatactccccgcaattctactgttgccgtttctcccgaaatcggtaagaaattagagcgtttttgtgattcatgtggtatcacgaagaaagattttatttccctttcgttagactattttcaacggtacgggataaatccggctaagcatgaaagccccgccaaagaaatggaaaaactaatcaagaagaacgaccaaataatcgggtttatccgtaagcaggagcaggacattttgcgccccatgcttgaagccataacaaccaccgaagaaagaataaaggctaatatcgggagtttggctacttctgataagttaatagaatttatacaagccgtagacagcaattccaatatacaggtagatacgagagataaattagcagaaacaatctccaaacagaacaaggaagtaaaacaagcgattttaactcttgcacgctatttggacgaaaagggaaaagcgggtttaattgatagactttttgggtgatgatagtaaaagtacagggaggcggtaaagtttacgccaacaccggcagctgctctgatgttgtttcctatttgcagcatgaagatgcagaacggctgcaagcagggctaacgcctgaaccgttctttaatcaggagcaggacaggataagccccaaagaagtaaccaacaagatagacaacaaccgaaagggattgaaagccaaagaagcaaagttctatgttatcactgttgcgccgtcacgtgaggaactccgtaaaatgggagccacgaaagaggaacaggcagcagccatgaaagagtatatccgtaccgaagtcataccgaaatatgcagaggggtttaataaagggctgaaagctgatgatttggagttttatggtaaaatccattttgaacggcacgaaaaagacggagaagatttgcacgcccatagttcctaatgggtgcctctaccggagcagcatacgcggtcgccaatcccggcgttaccgatgtgaaaatcacacaacagacagggacatgtacgggtatcgtcaaggatgctacgggagaaggtgttatcggtgcatctgtagtagtgaaagggactacgaatggtactatcacagggcttgacggtgacttctctttaagtaatgtaaaggaaggggatatcattgttatctctttcgttggttatgctactcaagaaataaaatggaccgggaaacctctagatgttcttttgaaagatgatactcaattgttgggtgaggtagttgtaaccgctctaggattgaaacgtgaggaaaaggcgctgggttatgccgttaccgaagtaaggggtgatgaattgaaagcagccaacaccatttctccggttactgcattacaaggaaaagtagcaggtgttgaaatttccagttcagatggtggtatctttggcgcagccaaaattcaaatccgtggtgcttccacgatgggcaataacaaccagcctatttatgtagtagacggtgttatactggataataatgtatctggtaatgatgacttgaactgggggagtaattccagtgactatggtaatgaattgaaaaatctaaatcctgatgattttgaaacagtttctgttttaaaaggtgccgcagcgactgcactctatggttctcgtggtttgaatggtgctgttgtaattactactaaaagtggcaagggtggtagtggattaggtatcagtttctctcaaacattcggtatcgaccatgcatataaaactccagatattcagactgtctatggtgatggtccgtatgtaggacgttatgacgcagatggtgatggtaatatctggcaaccaacacaattccaagtgaactcagctggacaacataccttaattggaacttggggaactggatttggtcctaaatatgacggtagtcaaattgaaaattatgacggtacaatgactacttattccccacataaaaataatatgttggatatgtatcaaataggtttcaacaccaatacaaatctagctattcatggtggtaatgacaaaaccacattctatgcttccatgtcttataaacatgctgaatccactactccgaataatacatttgagcgttattctttcttggtaaaagcaacacataaattaaatgattgggtagatgttgcagcttctgtgaatttttctaattcaacgccaagaaatgcagcacgcaatatcggtgaaaatttcgtaaacggaacatggactcccaattatgccccccaatatttccgtaacaaatatctcggtgaacatggtggagtggcaagtactgattatggtgacatctatggaaatgttcctggtaaaacctattggttcgaaattgataaatatgattatcgccaaaaagaaacagttgtacgccctacttttgaagttaatatgaaaataaccgactggctgaaatttaaagctgatgctaatatgaattattactacaatcgtggtgataacaaagaattaggaaccggatatgccaatgatggaggctattataaaatttggcaaaacacaaaggaacaaaccacttttggtggctcgtttacttggaacaaaactataaaagattattatattggtggctttgcacgctttgaatattataatactagcagatatgaatattctgtaaatactgacggaggtatggtggttcctggacaatggttcgttgataactcaaagaatcctaaaaaatccgatggtggattgaaaagcgaaaaacgtatgctttctgccatttttgctttaaatttaggatggaagaatcaagtctatttggatgttacaggacgtaatgattggtcttctgcattagtttatgctaatggtacaggtaatcattcttatttttacccttcagtttcaggttcttggattattagtgaaacattccgtgagcaattgcccgaatggatctctttcgctaaggttcgtggctcgtgggcacaagtaggtaatgataccgatccttattatgtaaaccaggcttatggatttggtacaattgaattgcctaatggcgggaatatttataccaatactttaaatacaataatgaaagcctccaatttaaaaccggaacgtaaaaatgcttgggaaattggtttggacttccgtacatttaaaaaccgtctgaatttggatgtaacttactataaagaaaataccaaagatcaaataatggaaatagcaactccttgggtatcaggtatcagtacacaattgattaatgctggtaatattcagaatcaaggtatagagttagctttgaatactattcctttccaaaatgaagattgggaatggggactagatttcacatggaccaaaaatacgagtaagattgtagaactccatccggatgcagctgaatatatttcacttgcaggtcaagtaaacgcctatgactaccgtattggttctgttgctaaagttggtggaagttatggtatgttaatgactgatattcttcctgctcgtgacgatcaagggcgagttttgttgaactacagtgatacgcgtcgtgctgtatacgaacgtagaagtggagtggttcaggaattgggtgatatgcaaccggattttttaggttctatgtcaacaagcctgcgctggaaaaatttaagtttacatgtaggtcttgatatgcgtatcggtggtttagtagctatgtatagcaaccgttacggttcaaatgccggctggactaaaacgtctttaaaatatcgtgatgcggcaagtggtggtttgacttggacaagtcagtatgcagggggtagcaatggaatcacctatgaagatggtgttattttagaaggagtgtttgcaccgggtacttcagctacaggtattgatggcaaatcacatgacatcagtggtatgacccatcagcaagctattgatgcaggtattatcgaaccgacccatgctagtgcatatcatgtgtttagaaattcttggggcgaaggtgtcgttaatgatgactgggtgcatgagttaagttacatagctcttcgtgatatcacattgtcatatcgtatgcctaaaagcatagcatcaaagattggtgctaaaggtttgaatttaagtttagcagcacgcaatgtaggctatatatataattcattgcctaataacgttcacccggaaagtgttcgtggtaatagatctgcagaattccgtatccgtggttatgaaccatatattagaaactatacgtttactattaatgccgaattctaatgcataatgctttaacaatataaaattgaattagtatgaaattaaaatatttatttgcttcatgcattttaggtgcaggacttttatcctcttgtgccgatgagtttaaagatataaactcaagtgaaggtgacatttcaactcctaatatccgttttttattcacggaatgcctatatcaattcgaaccgatggattattctgcatggtattatgattttccgcgtattggtgcttggggacagtgtattgttagcccaagtggtaatgtagacagttttaatctgataaccgagcaaggtagtacaggatcgaatatatacgatactttacgtatgataaatgatttacgttatcaaatttctcaaatgtctgatgaagataaagcacgttatggatatattcaatatctatgtaatcctttagctgtctttctggcaatgggtgatagcgatatgtatggctcacttcaatacacggaagcagagatggctcgttatggaggcacattgtatcccaaatttgacacacaggaagaattatatgattattggttgaaggaattggacgaggctattaactatcttacgactaataatattagcgatatcttaggtaatcaggatttcatatacaatggcgatgtcaaaaaatgggcgaaattcgccaactctttaaaattaaagctagcagcacgtcttgttaataaagacagaaacagagccattaagatagcaaatgaagtcatagccaatcaggctggtatattagaatccgcaactgatgattttatttataatcgcggaagaacaaacaatcactggaacaatgatttccctcaaggtgccggacatgatttattaattgactttatgaaagacaaccgcgacacacgtctgttaagtgccttcacaaagaatgagtttaacggagctgtaatacaagcattcttggatcaaggtaaagaaattcctccttatatcgccgaaaacgctattatcgaagacggtaaatttaaaggctggacaggtccaggcgaaccatgggtacgttattacggagcccctttaaagattggtgctggcttggaagagaataacaaatggatttttgaccctacaggtttattgttccagttaaaaacttccgcaggtggaacaagagattatgaagcgctgtcattccgcaatcaggaattagtaaaaggtatttatgacttcacttatccagatgcaccggatgtaacacctgataaagatattcaaataaccccatggtatggcatttatttctcagcagcagaagtacaattattattagctgaatttaaattattaggagctaatgcacctaaatcggctcaagaatatctgacagaaggttgtcgtttatctgcttatgtatatgacaaagcagcggaactcaatcaagttccttattattcacgtacttgtgtaaatgacccgctcgatgctactattaagattgatgataccatggttaatgaaatgctctctcatgatgctttcaaattaactggtgatactaaatctgatttggaaaaggtatatattcagcagtacatccactatataatgagccctcttgatcagtttataaatgtacgtcgttccggtattcccatgaaaaacagtacattattaccttgggaggaatttagtgatttattggattattcaacattaattccgagacgtttcaaagtaagtgaacctgctcctacagatcagatgcgtgatattacaattgcagcatataaagcgcaagggttctcttatggtactgacaatgcagatcctgacaaactaaactctcagcgtgtatgggtagatgaaggaaatccgcaatttggcgaaggacctaatttgaattaatgaaaaaacagtctgaaatatgacgctagtccaagtttattaataaaaaaggaagaggttatgtgatatattctcttccttttttattatacccaaaatcatttgatattctgatatcggcaaagcatattatgcataggtcatagagccacttaacataagccaaataaaaaagggcagtacacttgggcgaaggtctgaactttatttaaacaaatggcaatgtgagcattttattgctgcaactttaaaaaaactcgttttgtttatcgcgatgaacaatttattactatttttgtaatgtgtgataaacaaaaagaagaaatggaacgattatttgaatcctttatcaagaaactggctataacaaatacttcttttgtacgtagcctgatgaatgagatagaatgggaagctcgtcttatcggtataaagggggcccggggagttggaaaaacaactttattgttgcagtatatcaaactgaaccttccaatggataaaaccgtactttatgccagtgtggataatatctggttcagtgaacataaactttatgatttagcttccgattttgtaaagcggggaggaaaatatctgtttctggatgaagtacacaaataccccaactggtctcaagaactgaaaaatatttatgatgacttacctgaacttcatgtagtctttacaggttcgtccttgcttgaaatcttaaatgccaaatcggatttaagccggcgggctattgtttatgaaatgcaaggtttttcttttcgcgagtatttaaactggaatgaaaaactatcattgccgatattgactttaaataatatattggacaatcatctggcattatctgtcgggatagtagacaaagttaaagttctgaaacatttttctgattatttgaaacatgggtattatccttattacaatgaattacccgctctttattattcaagaataaatgaagtggtcaatctgattgtggaattggagattccacagttaagaggggttgatatttcatatacaactaaaattaagcagttactatatattattgcagagtcggcgccttttattcctaatgttagcaaactaagtgaacggataggaatctcgcgtaattcattgctggcctatctggatgccctccatgacagctgtctgactatgaatctccaaaaagaaggctccggcataagccgcttgcaaaaacctgataaactgtttttggaaaatcctaatttaatgtatgcattgtctgccagtcagattgatattggaaatgtcagggaaactttttttgccaaccaattgcgttattgccacaaaataaacgtttctaaagagagtgatttctttattgatggacgctatacttttgaagtcggtggtagaaacaaaggtaaacaacaaataaatggactttctgatgcatatattgtcgctgatgatatagagtatggaataaataataaaataccattatggttattcggctttctatattagtgctcttttcggtagaaaatagatagaaaattgtatttaaaagtccttctatagacttttaaatacaatttttctttttgaggcacaaaaataaaacacactgatattcagatacatagctgtaagagtagttctgaaggaactaaggaaacggaattacttgattttcaataaactttaaaaatctgctcaaggattccaaatctatcaatatcaatattgacggttcttgttttttccgtacaccatatatatatattacatatagtgcaccggcttgtactacttgtttgtttatcttaaatctttcaaagaactcattcacgtctatttccgttttttctcggaaatgttttgcaaagataaagcgtttatttcaaactaccaaaaaaacatcgaacttttttaaaacttttttgtttcatctatgttcttcaaatcatcttgtcagttttaaacttacctctcttgctaagcggatgcaaaagtagttgatttcatttctttatccaaatatatctactgttttttctattttttttgtgattatatttataaacatctgatttacagattatacgtaatgtttatttcgataatccattttacaatatcaaaaagtatacaccatattatattatcgcgcgcgacagactaaaatgaatattgggtaaacatcggctcacctgcaaaatcataggaaggggggcgctcttaaagtatcattttcttcttcgaacaatttccgaaagtcttcttgacgcatcattcaaaaaaagttgggagcatttatgccctcatgacctcacttcgtacacaacaaactcattataagcaacttatgtagttatagtaaaaattattgccctcacttataccctatgccctcactacgttttgaagctgatttctgtataacatgcttactttcagttatataaacttcttttttagactattccaacttgatgtaaaatagggtgttctcgtttttttgctcgcaaacagtgtgcatatctccacgaaatataatagtatccccggtagtggtaaaaaggccaagacacttttaaaaaagcccgttatcttttcaaaaaagctcttgttcttttttgaaaagctcttgatcttttttaaaagtgtccttatcttttggaagagaataatttcacagatgtctaccgagattttgttgacaacttctattgttattactcgcttcttttagctacaaaattaatgaacatcgagccttttgaagttatgaaaagtaacgcaatacattgaaagaaaaatcatttaccattttctgactatccgcatttgcaaaacaacgggtaagtaacggaattcgcagaaaaatatgctccataatactcgatttacctaccgccagccaagataaaagtccataactatttgattattaatcatttttctacttttacaaacagtaggaaacactttgtttccattagataaactgtatcattctgtttcttcctttttgattattgtcttctttttcttcattctgccactcttgcgcaaagcttccgctataatccattgaagctgtccattcgtggaacggaattcatccgccgcccatttctcgatagcttccatgatttccgcgtccactctgagcacaaagctttttatcgtttctttctttgccatctcctacactaatgattcaacgttccggaattaattaccggctgtgccggctcgtccgcacaaagtaccaccaacaaattactgaccatagcggcttttttttcttcatccagttctacaattccatcctcggctaatttatccaaagccattttaaccatagaaacagccccctccactattttttcgcgcgcggtaataatagcacttgcctgctgacgacgaagcatcaccgctgcaatctccggagcataagccaaataattgattctggcctctactatttccatacctgccatagccagacgctcattaagctgacgttccagctggtcattaatctcctcacctccgccacgcaaggtcagctcattcgtatcatgctcattgtcatcgtaagcatactgtccggccacctggcggagggccgcatcactctgcacacgtacaaaatcctcaaaggcattcatacgccctgccacgctgacacttgccgtccctgtccctttactgtccgccatcgtctgcgcgtcaatctcaaacatcgccttataagtatctttcaatttccagaccaaaaccagccctatcagaataggattgccaatcttatcattcacctttatcggctccacatccagattacgggcgcgaagagacaacttcttcttgttcatgaaagggtttacccaaaagaagcctgtgtttttaaaagtgcctttatattcaccgaaaaacaccatcacacgtgcctcattaggttcttgagaaaaatatcccggaagcatcagcacaaacaacaataccagcataaacaaaacaggaatagataaccaaggtagttgcccaaaaatcaaaaagttcaggaatactagtgcaggcaacataaccaagttaaaaaacaaagccataaacccattaattaccagctcattgtaagacatttcttttgtttccataatgatttatttttgatattattatgatatcacaaatcaagcaatacttcttgagataaacaaactgatttatatgttatacgacagaagcaaacaaaatattcaccaaaatgcaataagaaactcctactttttttgacctaaatcaataaaattgagatatcgattaaaaatatgctgtaaaacatatatcataacgaacaaactccttatctttgtgttgtaaaacataaaaagatatttttttagtagctactaaggtaaaaagaaagattatttaaagaaggccaaccgggaggtgcgcctgctatttatgagtgtttttaggtattaattaaaaaaagaaaggataacattatgaaaaaggtaaaaaacatttttcacaaaattgctaacgctgatcctatgatttggggttacgttatgttgaacgaaacaaagtaaattagaaccaatacagggcaatcccctgtaggactataaaaaaggacggttatttaaccgtcttttttatgcccttttacgggatttccactatctttgtccattcattttcaaacgtatggacaaaatgcaagtagacacccataataaagagtttcaagatgccttgaaccttatccaatatacacgtcagtcagtattcctcactggaaaggcgggtacaggtaaatctacttttctaaaatatgtttgcgaagtaaccaaaaagaaacatatagtactggctcccacaggtattgcagctatcaatgccggtggaagcacactgcatagtttttttaaattaccattctatccacttttaccggatgatcctaaattcagtttgaaagatggaaagttacatagctttctaaaatatacttccgctcatcgaaaactgataaaagaagtagaattagtgatcatcgatgaaatttccatggttcgggcagacattattgactttatagacaaaatattgcgggtatattcacaaaatatgcgtgaaccattcggaggcaagcaaatattgctggtaggagatgtttttcaacttgaaccagtcattaaaaatgacgaacgtgagataatcaaccgcttctatcccaccccttatttcttttcggcacgggtctttcaggaaatggagctggtatccatagaactgacaaaagtataccgccagtcggacaaaatttttgttaacgtattggatcatatccggaccaatactgccggagcagccgacttgcaactactgaacacccgttacaacactcacatagaagaaaatgaaagtgatatgtatatcacacttgctacccggagagacaccgtagactttatcaatgaaaagaaattatctgaactacctggagaatcaacgattctgaccggtgagatacacggagaatttccagaaagcagcctccccacccaaatggaactggaagtaaaaccaggagcacaaattatttttataaaaaacgattacgaccaccgttgggtgaacggtacgattggcaccatttcaggtatagacgaagaggatacattatatgttatcacagaagacggacaggaatttgacgttaaaaaagacagttggcgcaatatacgatataaatataatgaactagaaaaaaaaatagaagaagaagaattaggagtatttatacaatatcctatccgtttggcatgggccatcacgatacacaaaagccaaggattgactttcagcagggtcgttattgattttacaggaggggtgtttgccggtggacaagcctacgtagcattgagccgctgtacttcactagacggcatccaactaaaaaagcaaattacacgtggagatatctttgtccgcccggaaatagtaaagttctcgcaacgattcaataaccgccagtccattgaaaaagcattgaagcaggcacaagctgatgtacaatatgtagaagcggtacaacacttcgacaaaggtgattttgaaagatttctagaacaattctttcttgccatccattcacgttatgatatcgaaaaacctttgatcaaaagatttatacgtaagaagctgggaatcatcaacaatttgaaagtcgaaaacaaacggctaaaagaccaattccatgtacaacgcaaaaatcttgaaaaatatgcccgcgaatattatttaatgggaaatgaatgtatcatccaggcacatgattcacgtgctgctattgccaattatgacaaagcgattgaattgaacccttcttatacggacgcttgggtacgtaaaggtatcacattacataatgacaaggaatactacgaagccgaagtttgtctgaatgaagcggtacgccttagtcccgctttattcaaagctatttacaatcgagggaaaaacagactggcattagataatatagaaggagctttgggagattttgaccgggctgtttctttaaagccggaacatccgaaggcccatgaatatttcggagacgcattgatgagagtcggaaaagaagaggaagccgccctacaatgggctattgcagaacgcttgcgtgaaaaaaaatctaaaaattaaaataacatgcttttaagactttataataagaataataatcccaaagatctggaagaagtaatccgggtattggaagagggagggttaattatttaccctaccgatacgatgtatgccataggatgtcatggtctgaaagaacgtgcaatagaacgtatctgcaaactgaaaaacattgatccacgtaaaaacaatttatccattatctgttacgacttaagcaatatcagcgaatatgccaaagtagacaacagcacattcaagctaatgaaacgcaatcttcccggaccgttcacttttatcctgaatacgggaaaccgtctgcccaaaatattcaagaaccgtaaagaagtaggtatacgcgtaccagacaacaacatcatcagggaaatatgccatatactaaaagcacccatcatgaccactacgttgcctctgaaagatggcgaagacatagaatatattaccactccagaactgatagaagaaaaattcggcaaagaggtagaactaattattgacggaggaatcggaggcatagaaccttctaccattgtgaactgtacaaacggagaagcagaaattgtacgtcaaggtaaaggtattctgaacgatttttaatctgaattgttttatatattagaaatgtcaaattaaagtaaatttatcatgttattagcatctgaaacaagtattcaattaaccaatgcattagagaaacttatcgactccggcattcaattaggagaaagagtattaggagcacttattatttttataatcggaaagttcctcgtaaattggctgaacagactttttgcacgtattttggaaaaaagaaaagtggacccgagtatccagtcattcctaaagagcatggtgaatatcctactgctcattatgctgatccttgctgtgatagggaaattaggtatcgaactgacaggattcgccgcacttctcgcttctgccggtgttgccatcggtatggcactgtctggtaacttacaaaattttgccggaggactgattatcttattgttcaggccttataaagtgggggactttatcgaagcttctaccggtgcctcgggaacagtaaaagaaatacagatttttcatactattcttatcactgcagacaacaagatgatatatgtacctaatggagccatgagtagtggggtcattacaaattacagcaaactggacacccgccgtatagaatggaattttggtgtggactacggagaagactataataaagtagaaaaagtattgcgcgaaatcattgccaatgataaacgtattctcaccagtcctgccccttttattgaattaggagaacttgctgccagcagtgtaaatataaaaatccgcgtatgggtgaatagttcggattactggaacgtatttttcagtatgaatcagactgtttatactacttttaataaagaaggaattaacttcccattcccacagcttactgtacatcaagcctaacgtcagaaatctttagggacattcattaaatattacaaaatcagccaactaattcatacacaaagtattgaccaaagtctttgcggaactaacaaaacatataaagtgtttataatcaaaagattaaaatttgtcgattctatttatttactctgcgggaattactttaaacaaagttatgataaccttttttctacttttgttctacctcagaattactttatacgataaaaaagtctaattgcgataaatctcattatgataattgtattgtaataagattataatctttttgaaaaaaaaatgcatgaaataatgaaagaggagatccaaattggaatttagaaatgggagagagcaaaaaacgtctgttactttggacgaaatacttagctatctaggaaaagcagacaaaatctgcctagtggcgattgactaatttcaagttattgctcaagatccgattcgagaaagaacgttaaagccattttgagcatcgatatataacattgtacaatgcccattttatatatttaggttcacaatgtcatatgacgggagaaatttttataagtcttccggctttttatcaaagtactatgattttggatcaaaaatctatcagactgaaagaatatacaaaatttgttacacaccatttccagaaaagcgggaagtacattaataaaaatgttatatctgaaatatatcaactgtttgacggcataatatgctatatccggtctatgatcgtttttttgagttttggctgggaagaacattaaaaaactgatggaagattccgtgtgtaatcagaatttgacttcccgtcaggaattacaatcagttcataaggattgatggtggtttgttgtgttccttccaaatatgtaactaaatatttaacatatatgtctttacaggcacatttatatagtaatcgaatttgagttaacagatgtttatcgataatttccaaagaccgatttactatatagatttacccaagtatacattaattttgtatacttgggtaataatctattggataattaaggagaaagcttcatcttttcctcatatcttaaatctaaattatttagcaggtaggtaaagtatttctttaaattcaccaaaaccaccaacattgggtacatcatgcgacagcttcacagtaataactccgtcttccaaagcaccttttcctgaaacaaaaacttctccataggatgcgtgcttccatgccggctgagattctacagtgacctcattggcttcattaactttgaagacaatgttatatcctttttcatataagttcatagctttataccatgatatctggtctgctttttgaacttctacttcccaagttgtaaaatcttccccttcctctgccatagccgcagatttaaatgttccagttcctaatgaagaaaaagtataatccctataaacagttatgactttatccgaagtctggtctatcgtaaccatttcctccggcaaagatatcttgactttataattctgtccaggagttatatctccaactgtaacatgaatattggtcttaaattcccctgctgcgaatgaaaccgaggaaggtacggtaatggaggcagggagttcctgctctttatcaccgacaactaatgttgctgataaattaattgtagtagcttccgaagatttcgcgcgtaagacttccacatcaaaaccctcatatcctgtggaaggaaaggaaaccgattgtgtacctgtggcgaatgtcacccccattgttgtgccattgtatatatctccttcattgtcggtgttgcacgatacaaaaagagttgcagtggcaacaaacatgccgattatatatttatttactttcataatttacttgcttacagattaatactatttatgatcacctatcggattctgatctttgctaggatccatgttcggattaccatcaaattccgtttgaggaatagttaatacccatgcatacgactcaggatcttccgtatctgtaccagcaattaaagcactggatggccagcccatgtctgcagtacgtctgaacccttgtttcagacgacgtatatcatagatacgtccaaattctccccaaagttcaatacggcgttgaattataatttcttcaagtaaagaaccggtttcatccgaggtgagcttacctaatgccgttcctgtttttttgcaagtgtaatcctcatcacgttcttgcattaaactgttcaacatcagtcgtgcgcctttgtcatcatttaaacgacaagatgcttctgctgcggttaagaacatttcctcaatacgcataaaaatatagtcacctgtccatttcgcataatctttaaacttgaatttttcttgttggtaaccattcttttcattattctcgtcttgtggattccaccattttttgcggacatcatttgtgcctagctttgcataaagcagtttgtttatctgttttcgagcactagctccatatttcccttgatccgcatccatgtgtgtaaagaaacctgcatacattccggactggtcggctatgatttcggccgcccacatcacattattggcagtagcatcattcattccaccggttaccgcagttccagtgccgatactacacccacttttgcttattgcggcattcgcggcatccaaagcggtctgccagtcttccatcactaaagcgacacgagcctttatacctgaggcaacagcctcattgatatggctgatatgttttcttttacctgagttgcctagcatggtaattgctttgtcaagatccgaagtgatttgttgatatacttcttcaaccgttgcgcgccctttaccttctgttgcaatatcagtcggttctgtatagagtggtacacaaggttcgctttcatgtcctttataagtgcgagaaaacatttgcgccagcataaaataactgtaagcacgtacagcgtaggcttgtccaagcacataattcttttcggtttcacttccagacatggtttcctcttctgccaaaatgtaattgacattagaaatccaagtgtaatagccattccacatatcataagaacgccatccggtagaggtatatcttgattttacattgtaaacgcaatcataccaaaaccagccgctaccttgtccgttcataatgcaatcttcacccataacatctgccaccagattataagctgtgataccgaagcattgatgagtgttagagctgtttgaaacccctgctgtatacattgctcgatatacaccattcaatgatactaatgcattagttgctgttcctaataattcgttgccagaaacagaagatgaaggactggtttccaaagcatcctcactgcaagctaccacagacattgcagccatcccggcaaatatgtatttaaatatttttttcatactttcctgtattcttttaaattgttagaaattaatttcaaaacctactgaataagtcttgttgggagcataagaatagtctgtttcgcccttgaagttatactgtgggtccataccgtccaaatgagaaaataaagcgagattatctaccgatccgaatatgcggacagactctagcccggccttctttagccattgtttgggaatagtgtagcccaaagtgatatttttgatagcaaagtatgaagcatcaactaaaaaacggtctgaagctgtgtaggaacctccaatttgaatacgaggtacatctgtgatgtcaccaggttgttgccaacgtctcaaagcatgtttgttccatgtattgcctgcatacataacctccatagaaccagcgtataatgaatcataaactttacctcctatagaatatgtacccaatattgacaaatcgaaattcttgtaagagaaatcggtattgatactaccatataaatcaggtatacggctgccggaataatatttgctgttcgcagctttttgatagtcactgctgatatattcgttagtgatgttgccattatcatccttatcatatacccaatagagctgcgctcctgttgcaggatccacaccggcagatttagccatataatatgtattaataggcattccctctttaatactgaaaactcccttgataatttcaggagattccccagtcagtttcagcactttattggttacagtagagcccatccaagttaagttccatataaaatcagtggttttgataagggaaccacctaagctaaattcaaacccggtattacgcatagaaccgatattcgcgttgtattcagagaatccactagaagtagccttggggtatcccagcaacatatccgttgttttgcggttataatattcagcactgacattcaagcgtccgtcaaacatacttgcctcaataccgacatttaaattaccgcttttttcccatgaaagttttttgttttccaaagcaccgatcaggcctcctacttgattggcattcggatattccaatggatagagtccttgccaaggataataatctggtacatatcctccttcaagactatcatatcttaacagattatcattaccttgttcaccataactgattttagctgataaattagaaatccaaatcaaattctgcataaacttttcttgtgaaattctccagttggcaccgacagaccaaaaagtaccccaacggttatctttttggaagcgtgaagaaccgtccgtacggatagaggctgaaaaataatatttttcattaaagttataattgaatctcccaaagaaggattccacacgataatcttccgaatatgaatccgcattgtatagatttgtacccggacgcaattcaagaataccatttactaaattggtttttccggcagacagaaattcatatttgtatgcataaaattcatgaccaaccaaaagatcgatgttataaaagttaaaagaacgcccccatgtcagtaactggttaaaagtataagattgggttcttctgttatatttcatcaacaaaccgccggcagctgcctgattaccatggtgcatattcatatatgatttttgagatttgttccggtagtccagaccaaagttcaaagtcagcttaatacctttagcccatccggcatcttccgaatctgagccaaatgccaaaaatgtgcgcaaaccagctacatctgtttttatatcagccttgtcatctaccaaaccgcctacgggattgaaatcactatactgtgggcgttgtacactaccgtcaccgtagtccagttggcgatttccatcggcatctaatacatctttaccatcttctccctttatatacaccgggtaaatcggagccataaattgtgcagagtaccacacatttgaattagatgaaccttcgtaatcactaaaattttgtgtggaattggaaagtgacacattcaatccagtcttcatccatttattcacttcagtgtttatgtttgcacgggcattataacgttggaaaccggtattaatcaagatgccatcttcatttaaatatcccaaagagaacatatatttggtcttttctgtacctccattaacagacaactggtgttcatgacgaaatgcattgtctctttgtattgcatccatccaagattcattccatgcggatgtagcatcaccctgcactctacctgttgcaggatctataattgttccccatgtgtaatttttaaatggattatattgttctccacctaaaacgccacctaaatctgctgatgcttgtctaccggcagcttcccagttatatccattgtcaaagatatatccgttgcgtaaaccttcatacgttaactgtacaaattctttttggtcaaccatgtcataggctttcaaggaacgtgaagaccaacctgccgtagaacgccaagataccttagtcttgccttcttttccttgtttggtagtaatcataattacaccatttgcaccacgggctccataaagggctccggctgaagcatcttttaaaactgtcatgctttcaatatcggcaggattgatagaactcatatctccactaaaaggtattccgtcaactacatacaaaggatcttgtgaggcattgatggaaccgtaaccgcgaatcacgatcttggcagcttcgccaggttgacctgagcctgaagttgttaacagacctgtagtctgtccttccaatcctttagtaacattacttataggacgtaattccagtttcttattattaataacggatgctgatcctgtaaaagattccttttttgcagtgccatatgcaacaaccatcacttctccaagcactttagtatcagattttaaaatgatgctaacattctgtttgatagaaacctcttgactagccattccgataaaggaaactaccaaagtctttgcggaacttcttcaggcgtatgccttgccgtcacggtggccgccagtgccgcctccctgatatagaccgccaggcttcggccggacttccctgccctgaacctgagagcctcgtagctgacgggggagaacttcactgtcactcccttggtcagcttccgcgtcctgcccagtgccggacgcccgcgtcttttcttcatcccattcacatcctttgtcatatgttttttctttttcgtccgtacttctttcattccaaaatctgcgaccggcgggagcggatttgccctccctgcaaccgccgggcgcggggagcaagggttttcgggaatccggaaacataaccttgctcccccccacagaaaaatccccccgcattttccacattgaagcgggtacacaggggactgtgcatacatcgggtatactccacgcccggtaacaggctgtcagatttttctccactgctcgatgtcctcacggtaggcggcaagatgctccctggcaaggttctccagcagtccggaaacgctcatgccacgcccaccgagcctgcggacgatggcgtccagttcgtccctcacatcctcactgacgaacaccgtcttgcgattcctaatcttcgggacggtgaggtatgtttcccggtactcctccagcgaggccctgcgctgcctgccgctcgtcctttttctcacggggtcttccggttccggcggggtgtcctttcttcccgcttccccggacacttcttccgcaacggccccggatggaatcaccggttccgcatccgtaccggcggattctcccgaaccgggttccatcatgagtctttcccaccactcgtcgtggccgggtccgggactacggccgttctttctgtctgcggcttcggataccgccgttttcttccctttcgttttttcagtcggttcacttttcattgtacatggattttagatggttgatactgtgggcacagtctacccgtttgcccgattgtcggaagcaaataaaacgataataacaagtgctgtgaaacggacgggtccgattggcggggtttgccgtgttattcatattgttggatcagtctgacggtgatgacttcacaaatatacgcaccggaaatttcccactcttcgggaacggatctgaacgtctgtttactaaaagcaaatgaatgttaaaatccgattcccatgacatctgatgacatataatgacatctgatgaaggggcggaaccatatccgggaacaatcatttactttgcggatgaaacaagtacgcatatggtgtcaaaggtagtcatcctgtcttgaaattcaggacgttccgccgggattcactaaattgcggaacggaatccggatccgaaaagagaatgaaacagatgtcaaacctgaaattacagtgattatggaaatagtgaacattgaggcaaggaccttcgaggcgatgctctcggccttccggacgtttgcggaccggctggacaccctctgccggctgtacggcgacatggaggagaagaaatggctggacaaccaggaggtgtgcctgctgctgaaggtcagcccgagaaccctgcagaccctccgtgacaacggcacgctggcatacacacagatctgccacaagacatattacaagcccggggacgtggaaagtatcatccggatagtggaggagcgccgcaagcgggctgaaagtatgggaaggtcgatctgaaaggccatgaaaaacgaatgtcgaacaaaaaaagatcaagtcatgatgaataccgataaccgtctgctcacccgtgagagcagcgagcatataagagagttcttctccaccgtcgagcgtctctccgtttccatggagcgtctctttgccggcaggtcaccggcgatggcgggcgagaacttctatacggaccgcgaactggctgaaaagctgaaagtgagccgacgcagcctgcaacagtaccgtgacagcggtctgcttgccttcacccggctgggcggcaagatactgtaccgttcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccttgtatgtgacttcctgcggacgggagttttccctgttgtatactatcagtgccataactttcttacttttccgttaaacaattttttcaatacatgaagctttccaccgccagcatttggcttctccatgcgaaaccgctgtgggtacgtaccgcgtccactatcctgcatactttctgcgatatggccgatgccgatacgcccatgcattccgccagtgccttgaacgagaattgcgcctcatagaaccggagcatgaacatccggtactcctcgtaggagaacttctgccttacgaaacgcagtatgtccttaaccagcctctcgcacccgttcaggtcgtcctcggaaaggaattttgcctcctcgccacatcggagaaagaaatcatcttcagggtgtgcataccggttctcccttttaatctttaccagggccgcctttttgtagcatccgatgaaatacgcgtcatagtccgttatgtcctttccgggaaccagcacctgccttcttacgaaaaggtaggtgtcatggaaattgtcctcgtccagcattccgtaccggcgtaacgtccctctcaacctgtcataggattttgtgaaccactcgttgaacagtctttccttttctgcgctcttgtctgccatagccttatatttttttgagttatacatggcctacacgggtaggcattcttatttcttgtgcttcctccagtttgtttttcggcggtctccggcaaggcttgccgtgaaaaaatacgctcacgcaaagcgtgaggaagattttttcacgagcaaccagcccgcagggccgccttgcgggaccggcctgaaaaacaactatttttgccgcaagaaatgaggatgacggattacttccttctatctattgtctgtccgatgagaatttaaaattccatgcagcttttctgtcttcggtatgtttggagaaatattcaaggatatgaaatgagaacggcaatacgtgatattgcggaaggagcagatatgggattggaaacaggaagcgtgcccgggctttcatgcagtttatacggcggtgttgattttggggaggattacagggaagtgacaggaaggtcggccgttccggagaaattgtatgtgtacgttgttccttccgaaatacggagtcttttaaaatcatggaagacctcattcgggagtgtgtctcgatatttgcctgagacaaaattataagtcgcctattcatggataagtatttggaatatatcaacgacatgctacgatgcgataaagagcatcggaatgacagactggaacttgcaaccggctgataatgcgaactattctaaaacaagtgtggaaaacttgaagacatccgacggaaaaccttgaaaaaagaagaaccggacaaagtctccgccttcaaaataatgctctattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctaaaggattttactgatatattattatgtcagtcctttttcaaatcaaaatacagcaagcgggttttcaaaggttcatcttgcggaatatcataatattgcttttctatcacatctgttttatagagtggaacgaaaccgtttctttcataatacctgagaatcttttcctcattgtatgcatctaccacgataaaacggcagcctgtcttgttgtcctcatgacggaaccagtcttttatgaaagccatcagttgccgtcctacgtggcttgatgtaccctgatattcccggttgacacccagtcttcctatcagcacggccggatagctgcgtccacgtttaggatttacaatattgcgttgcagcctatttttatcattgggggatattaatctggtcttgatactgtcattggacaaggtaaacaaggccacaatacgatgcgggatttcagccgtcacccaacaatatgttttcccaaggagttcatccgcatacagatcggcatcattgagaaaaaaatcatcaaggtcattctcgccacaagtgaaaggaaggcaattcctccgtacttccttgttataggcaagcatgacacaatcatcatataaagaaataccgtccattgctgttaattgaaccggaatgaacgggatttctccaatacttttcgcaatcgtttctttgcctccactgataaccggggtgttacctttgcggcgttcttgtctgcactgcgtacgaaatcttccgccgtagcgccctccaaaaccggaatgttcttgatagttatagccatgatattattttttgcaaaaatacaactttgttgttatacagccaaataatagcccgtcttccactcttttttccggaatgttcctccatatccggaaaagtctgtgccacgccgcctgttgcggtaagccgtttctcctaaggaaagggcaggcaataccggcggacgtggatatgggcaaaacaacccgcatatgcaatgcagagggagcaggagagccttcaccacagccggagaggaaagcggtctcatgccggggtacggcatgaaaagggggctcccagacagttcttttccttgtcgcacatgcactacgtcggtcgcagttttcgccttctgaatccctcttacgtccgtccctgcgctttcggagcgtttttccggcagaaaatttcgccgtacggaaattttctgccggaaaccgaagggaaaacgcggagtcccgcagggacggacgaactttgatgaggaaggggaaaaatcatccgtttcataaataccatttcctcagatggcatcgcatatttccttctccatcttttccagcttatgggacaggatttccatgtcgctgctgatcttttggttggttatccgggcatatatctgggtggttttcaaatccgtatgccccaaaagacggcttacggtctcgatgggtacaccgtgcgagagcagcacggtggtggcgttcgtatgccgggccacatgataggtcagccgtatcttgaaaccgcactgcctgccaagttccttcaatatggtgttgcatctgccgttgctcggtactggaaatacatgaccgtccttggacagccccttatacttctctatgatgcgcttgggaacgtccagcaggcggatgttggactcggtgtttgtcttgcgacggcgggtgatgatccagaggttgccgtcgaagaaggtctggagccggtcggtcgtcagtgccttcacgtccgcgtatgcgaaagtcggggctttgtgcgtaaaaaacagaaggtgtgcattttgacacaccttcattttactttgtaaactattttgcagttattttatttcaatagttcgttcagtttggacttgatggcatctccacggagattacgtgcaacaatggtaccttcctgatcaaccaatacggtagcaggaattgaattgacaccataaagttttgcacctgcattgttccaaccttgcaggtcagacatttgcggccatgtaatattcaaggcagtgatagcctctttccacttgtctgcattctcgtctaaagaaatacctacaattccgaagcctttatctttgaaagccttgtatgcttctacaacattgggcatttctttacggcaaggtccgcaccagctagcccaaaagtcaatcaaagtatatttatttttgctgacgaaatcagacaggcttacagttttaccttcaggggtctgcatagagaaatcaatgtatttctgacctacagccgttttctctgaagtttcaatgtgggctttcaacttgttgatacgttcattaactaatgcagcgggaattttttctaccaacgctttttgtttgtcgagttcgaatgcgcctgcataggaagggagcagatatacaccgaccggattggtgatattggcttcaattgtttgataaaccatatccatgcctacactgtctttcttttcaatctcagccatgatagcttctacctgttcttctgtcaagctagtgtcgctttgagccttttggtacatttcattcatttccttgcttaaagccatgaagccatctttgaatttttggtaagcgtcgttattaggagtacctgaaactttgctttccttacctaaggttacattaatatttccattttcaagaaaaagatcagtaaagtaacgcttgtctcctttcatataagtgatgtagcggtttacagccgtatcttgttttccggtgaatacgaaagttccgcttttgacaatagcagaatcaagttttacaaggtttcctcctgcgtattcctgtaaatagatcgtgtcgccatcagtgatgtcttctactgaacctgtaaccttataggaaggcgaattctgacatgcaacgaaagccatacttcctgcagccaataaataaactaattttttcattttaatatgattataatttgaacgcaaagataactacttaattaatatgtttgcggaaaaaaggtttttattttcagaatgaaataaggaatctatagttttgctttgctttttttgaattttatgggcactcattcaattcctttggttataatttgtacagggggctgccttactgttacagttgatcggtaatattctggatctttcgaaaatcgaatcgggcacattgaagtttgtgtagagtgatgtgaatattaatgcaatgatgtacgatttggaggaattatttcaattacggaataaaaataatccggaggtggagatcgggtagatgttgaatccgagcagggagaaggtctcatttttttgtttacaatttctcaaaagcctatcattcactttgctgggagaagagaaatagtacgcacaatggaaaattattagtcggatgaataaatattactttatttatatcctccattcttgaaaaataccgtaattttgcaactcaattacaaaatgagtatgcaacaatctaattatataattgaggtaaaaggtgtttccaagttttttggtgataaaatggtcttggataacattaatttatatgtaaaaaaaggtgagtttgtaactgtgttggggccctccggttgcggaaagacaactcttttacgtttgattgccggttttcagactgcttcggaaggcgagataaagatagctggaaaagagatcacgcagacacctccgcataagcgtccggtaaatactgtgttccagaagtatgctttgttccctcatttgaatgtgttcgataatattgccttcggattgaaattgaaaaagatctctaagcagactatcgagaagaaagtaaaggctgctcttcgtatggtagggatgacggactatgagtatcgggatgtgaattccttgtcgggcgggcagcaacagcgtgtagccatagcccgtgctattgtcaatgagccggaggtgttgttgctggatgagcctttggctgctttggacttgaagatgcgtaaagatatgcagatggaattaaaagagatgcataagacattgggcatcacttttatttatgtgacgcatgaccaagaggaagctttaacactgagcgacacgattgttgtaatgagtgaaggaaaaatacagcagatcggaacaccggtggatatttataacgaacccatcaattcgtttgtagctgattttataggtgagagcaatattctgaacggaactatgatacaggacaagcttgtgcgttttgcaggagtggaatttgaatgtgtagatgaaggtttcggtgaaaatatgccggtagatgttgtggtacgtcctgaagattggtatatttttccggattcggatgcttcacagatttcaggtatcgtaacctcatccatctttaaaggtgtgcattatgaaatggtggtcgaggccaatggttatgaatttattgtacaggactatcatcattttgctgtgggtgagcaggtaggtttgttgataaaaccttttgatatccatattatgaaaaaagaacgtgtatgcaatacgtttgaaggagaactgacagatggaacgcatgtggaatttctgggatgtacgtttgagtgtctgccagtggttgacattgagccgggaactaaagtaaaagtgcaggtagatttcaaggatatcattttgcaggataatgaagaggatggaactttaaccggagatgtacgttttatcctatataagggagatcattatcacctcactgtgtcatcggactggggtgaggatatttttgttgataccaatgatgtatgggacaatggtgatcatgtaggtatcagcatctttcccgaaagtataaaaataactcagattgtagaatcataataaagaaaagaggtgctcagaacgatacgatttttcttgtcttcacgtaaaagttggactattccttacgtgatattttcggcggtatttgttattcttccgctacttttaatagtggtttatgcatttatggatgatgcggggcatttcacattgggaaattttgccaaatttttcgcccatcccgaggcaatcaacacatttgtttattctattggcgtggccattatcacaacagtggtatgtatcttattgggatatcctgctgcctatattctgacacagatgcggatgaaatatgcatcgacagtggtggtattgtttattttgcccatgtgggtgaatattttaatacgtacactggctacggtggccttgttcgattttatgaacgtatctttaggagagggggctttgatattcggtatggtatataattttttgccttttatgatttatcctatttacaacactttgcagaaattggataaaagttatgtggaagcggcgcaagatttgggcgccaatcccatgcaagtgtttttcaaggctgtgttgcccctgtctatgccgggtattgtgagtggtatattaatggtatttatgcctactatctccacatttgctattgccgaattattgacaatgaataatattaaattatttggcactactatccaggaaaatattaataatagtatgtggaattatggggcggccttgtcgttgatcatgttgttccttattggtgcgacaaccttgctcgcttcagatgataaggatcataacgaaggaggcggactatggtaaagaaaattttgtgtcaggggtatttgtggctgcttctgctattgctttatgcgcctatttttatcattatgatctattcgtttaccgaagcaaaggtgctgggcaactggaccgggttttccaccaaactctattcatccctatttgttgcaggtacacatcattcattgacaaatgccttggtcaataccttgagcattgcctttattgcagctaccgtatccaccttgctgggcagtattacggcaatcggcatattcaatcttcgtccccgtgcccgtaaagcaatcagttttgtcaataatattcctattttgaatggagatattattattggtatatctctattcttgctgttcgtatctttgggtattccacaaggatataccactgtagtgcttgcacatatcacattctgtactccatatgtggtgttaagtgtgttgccgcgtttgaaacagatgaatccgaatatttatgaggcggcgcttgacttgggggctactcctatgcaggcactccgcaaggtgattgttcctgagattcttccgggaatgatttcaggttttatgttggcggtgactttgtccattgacgattttgccgtgactgtatttactattggtaatgaagggcttgaaactctttccacctatatttatgcggatgcacggaaaggagggttgacccctgaacttcgtccgctttctaccattatattcgtattggtgctggtattgctggttatcatcaatcgccgtgcaggcaagaaaaaggaggtataaaaaatgaggaaaataaatagatggctgatggtgtgtgtgtgcgcgttattctctttaaccggatgctataacacagagcctcgtgagagtgtgctgaaaatatataattgggccgattacattgatgaggatatgttggcggaatttccccggtggtacaaagaacagacgggggaagatattcggattgtctatcagacttttgacatcaatgaaatcatgttgaccaagatagaacgcgggcatgaagattttgatgtagtttgtccttcggagtatatcatagagcgcatgctgaggaaaggtttattgcttcccattgataccgtttttggaaagacccccaattatctgcataatgaatctccttatatccgtgaacaattggataaattgagctggtcggggcatcgtgcttcagattatgccatcggttatatgtggggaacagcaggtatcctttttaataccgatcatgttccagcggaagatgccaggacttgggccagtctttggaatctgaaatatgagaacaagatcctgatgaaggaaagttatcgtgatgcatatggtaccgcattgatttatgccaatgccgaggatttgaaaaaaggcaaggttacggtagaggagttgatgaacaactattcgcaagcatccatcgatacagttgagaagtatctgaaagccatgaaacccttaatagcaggttgggaagctgattttggcaaggaaatgatgactaaaggtaaagcatggctgaacatgacctggagcggggatgcggtatgggcgatagaagaggctgaaggagtgggtatccatctggactatgaggtgccgatggaaggaagtaatgtgtggtatgacggatgggtgatccctaagtatgctagaaataaaaaggctgccagttattttattaattatttatgccgtcccgatgtggctttacgtaatatggacgcctgtggttatgtgagtgccgttgctactcccgagattttggaggcaaaaatagatactactttatcttactttgcagatttaagctattttttcggtcctgctgccgatagtatacaaatagataaggtacagtatcctgaccgtacagtggtggagcgttgtgccatgattcgtgattccggtgacaagaccgaattggtcttggaaatgtggtcgcgtgtaaagggggataatttgggggtaggcgtggttattgtgattctggtatctgccgggattatggtagtattcaccgtgtatagaaaacttcagcgttatcagcatgaaaaggctcaatatcctcgcaggaatcatcgaagaaagaaatgactttataagggaaggaaacatttagtcttgctgataaaacgatttagggaatccaatctttaggtagggatattcagtaaatgtctctaaaaaataagatggcatatgaagatgatagggcgctatgtttctaattataagtgaaatatatttattcttatttcgaactcacgttaactatgaactttgaagcattagtaaaacatatcagcacgatacagaacacgttgcaggcacaagccgcacacgctgtaaaccttgcccttacttcccgtaactggcttatgggttgctatatcgtggagttcgaacagaacggagaagaccgtgccgcatacggtgaacaattgttgaagaagctggaacaacgactgaaaacaaaagcctgaatgaacgaagattccgagaggttagacggctgtaccttgtttatccacaactgaaagaacctatcacacaatacattgcatcacaaatccaaattcggcacacattgagtgccgaattcatagaaccaattcggcggttgccatccgccgaatctgcaatgaacattcggcggataccgtccgccgaattgggaactgcaaaagaatggataattccggcagatagactctttaataaactcacatattctaatttaatgctcatctccgctattgacaaccctgtaaaacgagctttttatgaaatggaaaccattcgtggctgttggtcatataaggagttagaacgacaaatagcatctttatattatgaacgtagtggactctccaaaaacaaagaagccctctccgctttagtccagcaacaagcgaccttattacagcctaaagatgttatcaacacccctgttactttagagttcttaggattaaacgagcatgccttagtaacagaaaacgacttggagcaatccattcttgacaacctgcaacacttcctgctggaaatggggcatggattctgctttgaaacccgacaaaaacgtatcttgattgatgaggattatttctttaccgacctcgtattctatcaccgcatcttgaaatgtcatgttattgtggaattgaagatagacaagttccgccatgagtatgcttcgcaactgaatatgtatctgaactatttcaaagcggaagtgatgcagccggatgataatccgcctatcggtattctgctttgtactgaaaagggtgatacattagtgaaatatgccactgccggattaaatccgaatatcttcgtacagaagtacatgatagaacttccaagcgaggaagaaataaaggagttcattgcttcctcaaattactaacctatcataaaagtaatgctggcgaaaagaagaaaactatttttcttttcgccagccacatataatttgctgtcaacaagaataagtttagtccgttttggatgtataaacaaaaggataaactaaactacatactgcacaacaagtataattacaattttcctcaaattttaattgattaatcaatcaaattttccgtcaattgacacgataattttacttggttgagttcagataattgatgcagttcttttcaatcttgtccaagatatgaagaaatgtatcttgttcttcttgtgatataccttttaatgagatgtttagagatagcatttgacatttatttatatgcggcataattgtttttaccttatcggtgcagtataaaagaacactccgtccatctttatgatttttccgcttgatgatatatccgtttttggataatttttcaactattctcgtaacattggcaaagtctttttgcgactgtgtaactaaatcaccaatagtctgaccatcgttttcccataaattgactaaaagaacccactgttccggcgttatgtccagcccctcttctgatataatttgatatatttgacgtttgattatacccgaaagtttggctattttatgatttaccattttatctatatccatattatttagtttgttaaaagctgaaaaacatatttgtcatatcaaacaaatgaccatatttgtcatgacaaatatagaaataatgtaatgagtaaccaaatggaagtaagtgtttttatagaaaatatccaaaaggctttcggagaaaaggtacaattaccctttgctttttggtattctgataaacagattaatgatgatttgaaaaaaatcaacggttgtttttttaaggagtttgaaaagctgattggtggtgaaccaatctctttgagtgccgatagaatcgggtgtatgggtggtaaattctatactggtttttcgaccatgaatgaaaaaatgcctatgtttgtttcaagcaaagaaaaatataagaaatcttcagaattggttcttgatttcgtagaaaaggcaaatgtgcagattacgacaaggcagtatttgaatatttcacccattactgaacttgaaaactttaataatgtagtggggattttctttttggctacccctgatatgcttttaggacttgcttcatggacattttacgataacaattcggatgatgcaattactgcaaaatttggttcgggatgttcttctattttttcagaagcaacattggaaaacagcaaaaatgggaaacgtacatttattggactgtttgacccctccgtgcgtcgctatatccatgagaatatattaagttttactataccaatgtcacgctttcgggagatgtattatacgatacaagatagctgcttgtcgaatacacctgcatggggaaaaattagagaacgcatttgtcgggagtgaagtgtattacaaagcatccgatgtccaaaagttcattaagaaaagattcagcgtaaccacattgcgaaagtttgaaacagagcactgcacgaagaagaaatgaatttgaaaagccggggcggtgaacatagttcaccactcgaggcagaattcagttataagcattcttctactttctcaatattccagccactttctattttgtagaaatatacaatatatctaacattattaacagtaacgataacatatcctttttccggtacacctgttataccgtaagtctgagcaatcaaaatatttgctttatgataaattcccgccaagtccatattaaactttttttaattctacacaaagttacccaaattcgtaaatagtaattctttgcttaatataatatcagaacataaaacagaatcctttcttttgcgaagctttaaacctttcaatctccaaagaaagcgatttcttcaactgccctgccataaacgacaaaaacggctggttggtttcttcgtcctgacattggcgtagagaaaggatatattcttccctatcctctttgaatatcttagtaggaaaaaggtgataacaaaactggatgtagttcatcagtaatcgagccgttcttccgttgccatccacccacggatgaatagttactaaattaaggtgggcattaaagctcaactcgtattgttcccgaaatgttcccattttcttttgcttctcttgaagaatcgcacaaagttcatccaccttagcaggaactttcaaatagttcatataagaatgtccgccaacaccagccgtaacaccacatagacggaactctcctttagaagaatcaaaagagccacccatcacactgtgaacgctgccagtagtacgcatcagcattgcattcatccttttcagaaaagcaggagttataggtacaaggctgtctgattcaactttggcaagttcgtacgcttgcttcaaatcttcattcatcagatgatgcacaagcggtttccctttcgctgttactccctcgtcaaagagaagctgtgtatcaagttcggtcaatgtggagccttctatggctgtggaatgggtaatgagagaataaaggtagtacttatcatagtccaccgcttcactgataccaagtttttgaaacttctggtacaacagttctatttcttgccaaacaccttgttccattacttttatttaataggctttatttcttttcaaaggtaacttatttactacgttcaaccaaaagaaataatgacttactgctatattttttgcacgtgtggggaaaatttaaacaaaaaaagctaagtgattgacttctcaacacttagcttttatctttgtacccagacccggggtcgaaccgggatggaagtgaatccactggtgtttgagaccagcgcgtctaccgattccgccatctgggcatctcttgaaacattgtttgtttctcgattgcggttgcaaaggtacgactttttttcatacctgcaaacttttcggcattttttttcaaaaaaagataaatatactacgatttatgggataacggacaatggttttctaaaaataagccctatattagcggaaactttaaaacgattttatatcatgacaaacagcaataattattgtgtcatcatggggggaggtataggtagccggttctggccatatagccgcaaaaaccttcctaaacaatttcttgatttcttcgggaccggacgttctctaatacagcaaacgtttgatcgttataaaaaaatagtccctatagaaaacatctttattacaaccaatgtattgtataaagaactgatccaagaacaactcccagaattggacaaatcacaaattttattggaacccacccgcagaaacactgccccatgtatagcttgggcttcttatcacataaaaaaactcaatccaaatgccaatgtcattgtcgcaccgtccgaccacctgattttaaaagaagatgagttcaaagatgcaattttgaaaggtctggaatttgtttcaaactctcctcaattactaacattaggtatcaaacctaacagaccggaaaccggctatggctatattcagattgaggaagaaaaacaaggagaattctttaaagtaaaaacattcattgaaaagccccaattggaatttgccaaagtattcgtagaaagtggagaattctattggaactcaggaatattcttatggaatatcaatacaattttagaagctttcaatgagattatgcccgaagtttgtaccaaactgactaacggagaagaagattttgcctcctgtcctaatatctccattgactatggaatcatggagaaagccaacaatgttttcgtccaattgtgcgacttcggatgggcagatttaggtacatgggactccttgtatgatatatcatccaaggaccaagaaggtaacgtcgtagtaaacggaaactccttattatataacagctataataatgtaatagtagtgccagaagggaaattagccgtaatacaggatctagaaggttatttagtagccgcaagagacaatgtattactcatatgcaaaaaagatgacgaaagcgctatccgaaaattcgtaaatgacgtacaaatcaaactaggagatcagtttgtataaaaacaggtaaccggagtttaatcataaaggaaagaaggtgtgtcaaaatgcgcaccttctttttttatgcacaaagccccgacttaaaaaaagcctccggaacttcttcaagtccggaggcttcaatcaaaacggcggctacctactctcccactgtgacgcagtaccatcggcgtgacaaggcttaacttctctgttcggaatgggaagaggtggaacccttgtgctatagccacctgaataaggttgacatattgttgagctgttatcgtaatttcattctgtagtaaaaaccaaaggtatacaccatccgacatataaggaaagtgaacgggcaattagtaatgctcggctttgatgtctccatctttacacctgcatcctatcaacgtcgtagtctacaacgaccctgagaaatctaatcttgtggccggcttcgtacttagatgctttcagcacttatccgatccagacttagatacccggcaatgcacctggcggcacaaccggcaaaccagaggtctgtccaacacggtcctctcgtactagtgtcagagccacgcaaatttcatacgcccacgatagatagagaccgaactgtctcacgacgttctgaacccagctcgcgtgccactttaatgggcgaacagcccaacccttgggaccttctccagccccaggatgtgacgagccgacatcgaggtgccaaaccactccgtcgatatgagctcttgggagggatcagcctgttatccccggagtaccttttatcctttgagcgatgtcccttccatacggaaacaccggatcactatgctctagtttcctacctgatcgacttgttagtctcccagtcaagcgcccttatgccattacactctaaggccggttaccaatcggccggagggcacctttagaagcctccgttacgcttttggaggcgaccaccccagtcaaactacccaccaatcaatgtccccgttccacgggttagaatccaaacaaataaagggtcgtatttcaacagcggctccacaaatactggcgtacctgcttcaaagcctccgacctatcctacacatcacgtgcccagattcaatgataagctatagtaaaggttcacggggtcttttcgtcccatcgcgggtaatcggcatcttcaccgatactacaatttcactgagctcacggttgagacagcgtccagatcattacaccattcgtgcaggtcggaacttacccgacaaggaatttcgctaccttaggaccgttatagttacggccgccgtttactggggcttcaattcaacgcttctcttatcgatgacatctcctcttaaccttccagcaccgggcaggtgtcaggctgtatactggatctttcgatttggcacagccctgtgtttttgttaaacagttgcctggaccgattctctgcgccctcccataaaagggtagggaccctttatcccgaagttacagggtcagtttgcctagttccttaaccgtgaatcactcaagcgccttagaatattcatcccgactacgtgtgtccgtttgcggtacgggtacctacaggattaagtttagcggattttctcggcagcatgcttacgcgcactattgccttgtcccgaaggacgcggcatactgtcaggttcggatctcatggtggatttgcctgccatgatcgactcctacacccttcaaccatctattccgtcagatggcggcactgtcactactgcgtctccacgtcactcctgaaggtagtaacggaatattaaccgtttctgccatcggcatcgccgttcggctgagccttaggacccgactgaccctgatccgattagcgttgatcaggaaaccttagtctttcggcgagggggtttcccgccccctttatcgttacttatacctacatttgcttttccagacgctccagaatacctcacggtacgccttcgacgctgactggaatgctcccctaccgatcatattaatgatcccactgcttcggtagacaacttgatacccgattattatccacgcccgactcctcgactagtgagctgttacgcactctttaaatgaatggctgcttccaagccaacatcctagctgtcttagcagtcagacttcgttagtttaacttagctgtcatttcgggaccttagcaggtggtccggattcttctcctctcgggcacggaccttagcacccatgccctcactcctgcggtagaactgatgcgcattcggagtttgtcaagacttgataggcggtgaagccctcgcatcttatcagtcgctctacctcacatcagtaacccgcaaggctgcacctaaatgcatttcggggagtacgagctatctccaagtttgattagcctttcacccctaccctcagctcatccagaagcttttcaacgcttattggtgcggtcctccagctggtgttacccagccttcaacctggccaagggtagatcacttggtttcgcgtctgccactgccgactatacgccctcttcagactcgctttcgcttcggatacgtgtgtcgtcacacttaaccttgccggcaaaggcaactcgtaggttcattatgcaaaaggcacgccgtcactcattaacgagctccgaccgcttgtaggcgcacggtttcaggaactatttcactcttctgttcgaagtgcttttcacctttccctcacggtactggttcgctatcggtctctcgggagtatttagccttaccggatggtcccggcagattcacgcagaattcctcgtgctccgcgctactcaggatactactatgcttcgacaacattcgaatacgcaactgtcatgctctatggtctttctttccagaaagttcttctctgatgtcttcatgcaacggcgtagtcctacaaccccacccatgccgtaacatggatggtttgggctgttccccgttcgctcgccactactgggggaatcattgtttattttcttttcctgcaggtactaagatgtttcagttccctgcgttagcctcttacatagtaagataatacctcttcaagatattgggttgtcccattcggaaatctctggatcaaaggtcatttgcacctccccaaagcttatcgcagcttatcacgtccttcatcgcctccgagagccaaggcatccgccatgcgcccttctttactttccttatccattcgctcacacttgcgtgccagcgggatgatatatactttcagctctttactactaaaattactgtttgcttgtacaatatgtcatagatcgttcatcttcgtttcttacgtttccgatggagtggagaataacggattcgaaccgttgaccctctgcgtgcaaggcagatgctctagccagctgagctaatcccccgaacttgattccgttcgtagtcccaggcagagttgaactgccgacctctacattatcagtgtagcgctctaaccaactgagctataggactaagttcaacctagtctgtttaattagacccggcttcttactttctctcttccgtatcattacggaatcatatcttgaataaacaacaccagcagtacaagaacaaaaaccttatcgatctttcgtcctctccagaaaggaggtgttccagccgcaccttccggtacggctaccttgttacgacttagccccagtcaccagttttaccctagggcgctcctcgcggttacgcacttcaggtacccccggctcccatggcttgacgggcggtgtgtacaaggcccgggaacgtattcaccgcgccgtggctgatgcgcgattactagcgaatccagcttcgtggagtcgggttgcagactccagtccgaactgagagaggttttggggattggcatccactcgcgtggtagcggccctctgtaccccccattgtaacacgtgtgtagccccggacgtaagggccgtgctgatttgacgtcatccccaccttcctcacatcttacgatggcagtcttgtcagagtcctcagcatgacctgttagtaactgacaacaagggttgcgctcgttatggcacttaagccgacacctcacggcacgagctgacgacaaccatgcagcaccttcacagatgccttgcggcttacggctttcaccgtaattcatctgcaatttaagcccgggtaaggttcctcgcgtatcatcgaattaaaccacatgttcctccgcttgtgcgggcccccgtcaattcctttgagtttcaccgttgccggcgtactccccaggtggaatacttaacgctttcgcttggccgcttgccgtatatcgcaaacagcgagtattcatcgtttaccgtgtggactaccagggtatctaatcctgtttgatacccacactttcgagcctcaatgtcagttgcagcttagcaggctgccttcgcaatcggagttcttcgtgatatctaagcatttcaccgctacaccacgaattccgcctgcctcaactgcactcaagatatccagtatcaactgcaattttacggttgagccgcaaactttcacaactgacttaaacatccatctacgctccctttaaacccaataaatccggataacgctcggatcctccgtattaccgcggctgctggcacggagttagccgatccttattcataaagtacatgcaaacgggtatccatacccgactttattcctttataaaagaagtttacaacccatagggcagtcatccttcacgctacttggctggttcaggctctcgcccattgaccaatattcctcactgctgcctcccgtaggagtttggaccgtgtctcagttccaatgtgggggaccttcctctcagaacccctatccatcgaagactaggtgggccgttaccccgcctactatctaatggaacgcatccccatcgtctaccggaatacctttaatcatgtgaacatgcggactcatgatgccatcttgtattaatcttcctttcagaaggctgtccaagagtagacggcaggttggatacgtgttactcacccgtgcgccggtcgccatcggccttagcaagctaagaccatgctgcccctcgacttgcatgtgttaagcctgtagctagcgttcatcctgagccaggatcaaactcttcattgtaataatatctttttccaactatccagttgataatctgctcaaggattccaaatctatcaatatcaatattgacggttcttgttttttaatcttttgattataaacactttatatgttttgttagttccgcaaagactttggtggtttcctttatcggaatggctacacaagaagtgaatattaaagcgaatttgaatattgtattaaagtctgatacagaacagcttgaggaagtaatggttgtggcgtacggtactgccaaaaagtcttcgtttacgggatctgctgctgttgttaaaaatgacaaaatagaaaaaatgcaaacgtctgatgtgaccaaagcattagcgggtgcagtgtcgggagtccaaattaccacagcttcaggtgcccctggttctggtacaagtattcgtgtacgtggccttggttctattaacgcttccagtgaacctcttattgttgtggacggttctccttttgatggagatttgagtatgattaatagtcaagatgttgaatctatgactgtattaaaagatgctgctgccaatgcattatatggtgcacgtggtgctaatggtgttgtcttgattactactaaaagaggtaaaataggtaaagctactataaccgttgatgctaaatggggatctaatagtcgtggtgtacctgagtatgatgtaatgagagatcctgctacttattatactacatattggcgagagttgaaaggaatgtatgaggctaatggcgaggctaatcccggacaattagcttcgaacgctttgattaccgacagtggtagtggcttgagttacaatgttacgactgtaggtaataacgaagtggtattaccggatggaacatttaatcctaatgctagaattaaatatgcggataattgggaaaaggaaatgtttcacagcggtttacgacaagaatataacgtaaacatgaacggggctaatgaaaagactagttattatttgtcatttggttatttggatgatgaaggttatattgtaaaatccggttttacacgttactctgcccgtttgcgtttggaacaccagtttaacaagaatattaagatgggtggtaattttgcttatgtcaatacttctactgtagccacttcagctacagaagaacaagaccaaactgctggcaccaatatgttctacgtatcacgtaccatggctcccatttatcctatctacaaacgtgatgaaaatggtaattttatgtatgatagtcatggtcgcatagtgtatgattatggagatactccgggtatgcagcgtcctgtatcaggaaattcaaacgcattaggtagtcagagtttggatgatcgtaaaaatggaaaagattatttcagcggaaacatgtttgccgaaatttcctttttgaaagattttaaatttactttccgtgccggaatagaaaacgataatactcgtcaaatggtatttcaaaatggtgaatacggacagtttactgcacaaaacggtattgcaactcattatagcactcgcaatatgactattaatttgcaggaattgcttacatgggaacgtacttttggagagcattcggtaaatgtactgcttggacatgaaacttatcagaataagtatgattatttatacggatcaaaaaataactttgctttgtgggggtcaacttcattgaatcatgcagtgagtaatccgcaagctggttcttatgtgacagaatatactactgaaggtttcttgggacgtgtggaatataattataaggatagatattacttctcgggaagttatcgtcgtgatgcttcttcagtatttcatccagattatcgttgggggaatttttggtctgtaggtgctagttggagactgaaagaggaaaattttttgaaggacgttgaatggttagataacttaaagtttaaagttagctatggttcgcaaggtaatgactacttgttgttgaatggggtgcgtaaccgttatgcttatatggatcaattcagtgtgagcaacaataacggacaacccgcaattactcaaacatataagggtaatgataaattaaagtgggaaactaactataattttaatacaggtattgaatttagcgtattaaacggacgtttgagtggaggctttgaatttttctcccgctatgcaaaagatttgttgtttaaccgtcctttagcagctagtaccggttctaattcttatccggataatattggtgatatgcgcaataccggatttgaagtagaattaagtggggacattattcgcacaagtaagattaattggaatatttctgttaatgcaactacctataaaaacaaaattttgactttaccggaagaaaaaagagagtccggtatttggaatggtattttcaaaatggttgaaggaggttcgtactacgactattatataaaagaatgggctggtgtagatccggaagacggaaaggctatgtggtataaagatgttactgataagaatggaaatacgactaaagaaacaactaagacatatagcgaggcgacggattataaagcaggttgtgccttgcctgatttgtatggtggtattagtacttcattaaatgcttatggattcgattttagtattgcacttacttatcaattaggaggacaaggctatgattatacctatgcaactttgatgaatagcgctcagggtgcaggaacaaattatcataatgatattttaaatgcttggacaccggaaaataaatatactgatgtgccaaaattaaatgcaaaagaaagtaataacaattctacttctacccgttttttgacttcaacttcgtatttaagtttgcaaaatatttctgtaggttatacattgccgaagaattggattgcaaaattgggttgcgagagcttaagagtatattttgtggcagacaatgtagcactactttctgctcgtaaaggttatgaccctcgtacaaattggaatggcgaatcaaattataattattcggcattgcgtagtatttctggtggtataacaatgaaattttaattgataaaacaagaaagcatgaaaaaaattttaaaatatacggcttttgcagccatggtaggattgtttagcagttgttctgatagtttttttgaggctgaatctggtgatatcattactagtgatcagatggatgaagttgatccggtggcaggtttgaacggtatgtatgcctatttgtataaatttgatacaatgggatatggtgatgaagctcaacattacgattatggttatcatcatattttgttatgttcggatttgtgggggcaggacatgattcagtatagttctaaatatggatggtattatactgattatcaatttaatcagaattctagagcataccaatatatttctacgttctatttttggaactatttgtataaattaataaaatcggctaatgacgtattgaaaacaactacagatgattctaaaaaagaagatcgtggacaggctttaggtatgcgtgcttttgcttatttgactttggtacagatgtatcagcatacttatgcaggtcatgaaaatgctcctgcggtacctattgtcctagaaactaccgagccagatgtattgagcaataatcctcgtgcaagtgtaaaggaggtttatgatttgattgaaaaagatttagtgcaggcacacagtgatttatcttcataccaacgtttgaacagcacttatatcgaccaaactgtgatttctggtttattggcacgtatgtatctgttaaaagaagattggactaatgctgccaaatatgctaaagaggctcgtgcttcttatggagcacctgccgataaggctgaattgatagatgagggttatatcgatatgaacaaacatcatacttggatgtttacctcacatattacaacggatgcggagattgttcagacaggtattgttaactttatctcccacatcagttctaccgcttatggttatgtcacggctggaggaatgttcaagaatattagttctgaattatacagtaaaatagctgacaatgatattcgtaaaggatggtttgcggataaggactttacttatgaaggaggaccgatgggaagtgtagctttacctaaatatgctaatttgaagtatatgtggtatgatttggaaggtaataattgcaacgatctgtgttatatgcgtgctgaagagatgtggttgattgaagcagaagctttggctatgggaggtaatattgccggtggtaaatcattattagaagaatttgtgaaaacccgtcaaccggattatgtatgtgatgcaacagatgcaaaaggaatacaagatgcctgttggttacagcgtcgtatcgaattttggggtgaaggcattgcatggttcgatttgaaacgcttaaagaagcctattattcgtaaatatgaaggaaccaatcacaatttggatgcacaatacgattttccggctgaagatgatatctttagaattttgattccaagaaaagaaattcaagataataatggtattggcgaagaggataataatccaatgcctaatatttaataattctcatattaacttttctataaaagggatgttcttaattgtaggaacgtccctttataattatagctacaattatatttcactataaagtttaaagaaatacctttgatagtgtctttttcatgataataaaaagcttttcttacaattagtttttgtttcaagcattcgttttattccagtaataaatattgtgatatgactattgtaatgtttatttgattaaaataatatggaatttcatttcataaataaatagaacaatggcaaatttagcgaatttatataaattggtttacttatttcagtagaataaaggtagaaaattattttttttatacttctcaaacaatttatatagtagaaaagcaggcaaagcgaagaaatacttttgtgttgattgtcagttctttacataaataattagttccgcaaagactttggtagtttcctttatcggaatggctattttaaagtttattgaaaatcaagtaattacattttcttagttccttcagaactatgtttttcaatttaatttagattaacggtgcaaatatataacaattttaatatatataaagaatctattgaaaaatatttttaatatgctctgatttttaacgtttgagatatctggagccccctatttaaagagagaaccgataactttcacagaactttcttgaaatgatttatattgttttttcatcgaatatttaccgtttgtttggtagtcggtagaaaacaggtaacgcatattgggataagaaccaaaggaaaaaaggtaatgccagtccatgccgttggtgtattgctagagaaaatataccttttttatatagacagtattgcagacaacaatcaaaagatgaaaggaaagaaggaatatgaaaggaagaacggaagagggaaagaagtccaaacaaactgtaggctgtaattttaagtccttgaacttgcccatgtgacaacttgcccaaggacaagattgtcctttgaggagatagaaaagttggaacattccttgtcctgcggtgacagaaacatttctgttatcgcaggacaaaggaatttacattaataaataagcgtacctgagatacaccaataactattgcttcccccttcgggagcaccctgtggtatttttacggtgatgctgtgttcacccgcttccagatcacccaaatagatgtattcgggattggtcaccgtacccggacaccagttggaacggctcaagtcggaagagctcagtccattggagaaattacccgaacaaggattccagttacgataagttccacaatcatcccgccaaggtacgaaagagatcaccttttcaccgtccaaatagagagtgttcggtttctggttgaactcatcaccgcctccccaaccgccatgtcccgtggtgagatagtacagacgggcgttcttggcaggctccttcaaggtgaactttacggtcagagaatcctgacgcatgaaaatcggataaggctgtcctgcctgctccagataattcactgtattgaacagcggaagagtattataaacccgatgttcttcatcaggataatacttcagtttcaacgacagacgatgtcctttggcatcccagttgccgatgtaagcgccaatccaagcttccccttccaatttttcggccagtggggttacctccattttgtaaagtacggagtccacccagtcctgtcccttcaccttattataattgaacttgcgcacaccgaaaccggtgaagaaacgcatcaactctaaaggcacatcatactccgctgtggaaatcagcccgtggtagtccgtattttccgagcggaaagagggaactttcttcaaatcacgtatggcatcaagaaaagacagctgcttgccttccggtatcagaaagacagaaccggtgcggtcgtaagcatcaccgtccgagtattggacaacttccgcaaagacggtacgattcttcacatagtcgggcagcttcactttcttcaacaggatggtgccgcctccggcactgtattgtacgccatcctccagtacttcgggcaatttagcgttgttgaagcagatgctctgctggtcgaagaccggaattgtgataactccgctttggttgatggtatattggtagtcggccgcatccatgctttccccccacgactgtggcaacacatcctttcctttcttcagcggggtaatatgggtggcttcctgaatcatgtcaccgtttcgcacgactctcagtaccaatccgtcaggtacacccacattggcttgcggagtaccacgaaaagggatgtcgttggtataccacacctcgatggtgttggaattgatggatgtgcgcaaaattttgcagttcatccctaagtgttttccttcgcccgtttgcgtgaaacctttgccgaattcgaagggagtgaccgcagatatcacttgtccgttaggtagttcagccctgcggtatgcctgccgggtagtgtagtctatgtaactgccggttacaggtgtcttgtcttccgggcggggattgggacggtcgttttgctccggccatacgttggtcaatgatacgcggtcactggacacggtcatcaacagatgccccggccgggctttccctttgtaattcgattggtaggtcacctcgataccttgtgcattcttcacttttccagggtagttctgcgcgcagaccgtcccggtgctaagcaggaagcacaagccgattcctacgtttttcaagatggttcttttcattttttcttattttaaagtatgatataacaattcgttttacatgaaacacaaaattctcccttcaccctatccggctcgttaccagcgatctgccgtgtaggaacgtccgtaatgccctttaaccggtatgtaggcagtggcatttttgtagccctcgcgttgtaatgacggatgggctccttgggtcagtgcctgtaggcggcggtatgcggtagaacgggtcattccgcagacctgctgcatccgggcgcaggtgatactgcgatgatctttaaaatattcactcagcagcccgtccacttcgataggcgacaagtccaccgtgtgcaccttgtatcgttctcttacaaaatgtgcccggcttataatactcttcttgaaacttttctcaggctggaagttgactcctgttatctgtactgtgccacgggtcatcttcttaggattttcactttctgtggagccgatactgacagagaaataccctaatccgttgatatggattcgtttgccgtcacctaatttctcggacagaatatctatcagtccctctaccactgccgcccagtccgaacggcttactgaagtataaagcgtagcctcgtgtatcaagtccttcgagtggatggtctgcttgttggtgtttctcacatggtattttttcttttccccgtcatttgccggagattcatagatatcaaatttaatgtctgacataatgtactatgtatttgttttatttataggatgttatcgtgcaaacttacagaacattctgttgcttcaccttagtgaagcggcagtttcacccgtgtggcaatggctcttcactaaagtgagtaggcaacttcacgtcagtgagaacccagattcttccggacgaagatacggattctttcgtcctcttgcaaagattctgccataaatgtttcacacgttggatttattttaatttgtcgggcaaagttcttgcaaaaccctgttttgcagaactatcttcacacctcaaatcaataaaaaaacagatttaatggaaaaagaaaaagactcaaaactgaaacaagccatgaaagggcttgattcgttcctcaccactcattattcctttcgttacaaccaaataacagaacaatgcgaatttcatgacaagcacaagttcgataaataccgtgtggtggatgagcgagaattcaacacattggttattaatgcaatagaggaaggcgtgaactgtatggaccgtgatatgcgccgttatctgggttcgtcacgcattccttcttttcaccccgtgacagcctatttggaacatctgccacactgggacgggcacgacagagtaagcgagctggcacactcggtaagcgatgaaacgcaatgggtggaggtgtttcatatctggatgctgggcatggtgatgcaatggagcggtaaaaaccggatgcatggcaactgcctgattcccattttggttaatccccttcagggcctgaagaagtctaccttttgccggtcgctccttccaccagcgttacgtggatattataccgatgacttcgatgtgacccgcgagggggataccctgcgcaaaatgcgctctttggctcttatcaatatagacgaattcaatcggatggaagaaggtaaactggcacggttgaagaatctagtccaaatgagcggtcttagtatgcgccgtccgtttcaaagcagctatagccagcaaccgcgccttagttcatttattggcacttccaatttttgcgatctgctgaccgattcttccggtaaccgccgtttttatccggtgatgaccaaagggagtatccgtttgcctcgcatcaattataaacaactttatgctcagttaagagatgaactaaaacataaccgccgctattggctctcacccaaagaagaacaggctgtcagcttgcgtaatgacgcatttttgcgccgtcccatagaggaaagcctcttttatagctgcttcagtctgccccgggatggggagaagtttcaaagatggactatcggccagatttatgaagtgatgaaaaaggccagtcctgaaaccatgcgtgatgtcaagatgagagccttcggaaaacatttggctctgatgggagtgaagaaattacatacccgctatggtgaccagtatctgctgaaccggctctaactgataaaccatttcgaggaaatactgaaagttctgtcaccatataatattgaagtccagcgatatgtggtgacagaataaaaagtattacaatacaatatttattaatcctatcctaatttaaatttgactatggtaacgggatggtagctagtagaaaactggtagaaatcgcaaatttatttcctgtttgtaaattcaaggacaaagatcatcttaaaattactaaagtacatatgctttgattatcagatacatagctgtaagagtagttctgaaggaactaaggaaacggaattacttgattttcaataaactttaaaacaatactttgtgtatgaattagttggctgattttgtaatatttaatgaatgtccctaaaaaaaagagcgtaacctataacaagttgcgctctttatggtataaaaaagaatgttcttatttcttttcttgcttttcaggacgaggcagtaatactttgtgagagagcttgaatttacctgtcttgggatcaatatcaagtaacttcacttctatttcatccccttcttttaaaccggcctcttctattgtttcaagacgtttccagtcaatttcagagatgtgtaacaatccgtctttaccaggcaagaattctacgaacacgccatatggcattactgaacggactttacctacatagacttcaccgacttcgggaacggcaacgatacccttgataatgcgcatagcatcgtcaatacatttcttgtttgttcccgcaatctcaatgcgacctactccatcagtttcttcaatcgtgatggttgctccggtttcttcctgcataccttggataatctttccgcccggaccgatgatagccccaatgaactctttaggaatagtcatcgtttcaatacgaggagcatgcggtttcaaatctttacgaggttcggctatacattcggttaacttgttaagaatatgttcgcgaccttcttttgcttgcagtaacgctttttccaagatttcgaatgatagaccatctaccttgatgtccatctgtgtagcagtgataccatcacgagtacctgtaaccttgaagtccatatcacccaagtgatcctcatctccaagaatatcagacaatacggcatatttttcttcacctgcattcttaatcaagcccatggcaatacctgaaactggttttttcatggcaacaccggcatccattaatgcaagcgttcctgcacagacagtagccattgaagaagaaccatttgattccatgatatcagatactacacgtactgtgtacgggtagcctgcaggaatttgtcctttcaaagcacgccatgccaagtgcccgtgaccgatttcacgacgacctacaccacgttgtgcttttgcttcaccggtagaataaggggggaagttgtagtgtaacaagaatcgttctctgtgttgatccagaacatcgtctacgattttctcatctagcttggtgcctaatgtgacagaagttaaagactgagtttcaccacgggtgaaaatggcagaaccgtgagggccgggcagataacctacttcgcaccagatagggcgaatttcagttgtcttacgtccgtccagacgcttgccttcatcaagaatacaacgacgcatggcttccttttccacatcgtggtagtaacggtcgattaatgcacctttttcttccagttcttcttctgtatattgagttttgaattcatcgcggatggcatcaaaagcatcttgacgttcatgcttgtttctgtttcctgaagcagcgatggcgtatgctttatcataacaagcttcgcgtacagctttgcgtaaatcttcatcgttttcttcgtggcagtattcacgttttactgtagaaccgacctcttccatcagttccatctgcgctttacaatgaactttgattgcttcgtgagcagccttcatggcagccagcaagtcttgttcgctgacttcctgcatttcgccttctaccatcatgatgttgtcatatgtggcggcaaccatcagatccatatcagctttctcaagttgttcgaaagtggggttgataacgaactggccatcgatacgcgctacgcgtacttcagaaatcggtccgccgaaaggaatgtcggaaacggctaatgctgctgaagcggccaatcctgccaatgcatcaggcatatctattccatcagctgagaaaagaacaatgtttacgtaaacctctgcatggaaattatcggggaataaaggacgcaatgcgcggtctaccagtcggcaagtcaggatttcataatctgaagctttgccttctcttttggtaaagccaccgggaaaacgtccgaatgctgaatatttttctttgtactctacctgaaggggcataaaatctgtaccgggaactgcatcttttgctgcacaaacagtagctagcaacatggtgttacccatgcggagcattacagaaccgtctgcctgttttgccagctttcccgtttcgagtgtgatggttctaccatcaggaagctcgatcgtcttaacaattggattgatcataaaaaatgttttaatatatttttcgtctaaaattcgtgcaaagataggcatttattcttctaatttggtgagaatgagataaaaagttactatgattactgttttttttcattttaatgtgtaagaaggtggataaatgctttgacaaaccacgaaaagacgtatctttgcatccaaaattattaagagaacacacatttatattaattttagcgatgaaaaagaatgtatattttttgctcgcacttctgttgatagggttgagcgcctgcgacaatgcaccgaagttcaaagttcaaggtgaaattaatggtgctgaagataagatgctttatttggaagcgtcgggattggatggcatagtagcgcttgattcggcaaaattgggcagtagcggaagttttagttttgcacagaagcgcccggaatctcctgaattctatcgtttgcgtttagataataaagtgataaactttgctgtagactctacggaaacagtatcagttaaggctgagataaatgattttgcgactgcctatcgtattgaaggttcggaaaacaatttgaaaataaaggaattggtgttgctgcaagctgatttgcagaagaatgtggacaaactcggtcagaaccgtaatatccctgcgggcatcgcacaagacagccttttggctatggtaaacaattacaagaataaagtgaaacgagaatatatttttgcggctccaaatatgccatatgcttatttcgctttattccagtcgttgaatgggtatatgatttttgatcctttgacaaataaggaggatgtgaagtgtttcgctgcggtggctacgagtctgaataatgcttatccacatgccgaccgttcacgcaacttgtacaatatggttataaaaggaatgaagaatacccgtactccccgtcagcagaccatggaaattcctgaagataaaatcaaggaagccagcattattgatattcagctgaaagacttgaaaggcaatacacgcagtctgaccgatttgaagggtaaagtggtgctgatcgattttactgtatataacaatgcaatgtctgctgcacataatttggcgttacgtgaactttataataagtatgcttctcaagggttcgagatttaccagatttcactggatggtgatgaacacttttggaaaacatctgcagataatctgccttgggtctgtgtacgtgacgctaatggcgcttattcttcatacatttcattatataatgtaactaatctgccttcggtatttttggtaaatcgtaataatgaattaagcgcccgtggtgagaatattaaagatttggatgaagccattaaaaaactcttgtaaaaagctaattatgagttgaatttgtttaaacatgttacatagcatccttataaacttgactcgtattagataaaagtctatctttgcaagacttgaaataccaaagagggttccgacatttccatgtcggaattctttttgtttttataggcataactggaacaatgaataattatataatttaaaaggaggaaaacattatggcttatatgtcagaagaaggttacaagcaactgattgaggaactgaaatatctggaatcagtagaacgtcctaaaattgtgtcggctattgccgaagcgcgtgataagggagacttgtcagaaaatgccgaatatgatgctgccaaagaggcgcaaggtctgttggagatgaagatcagccagctgaaatcaactattggtgatgctaaaattattgatacttcaaaaatgaatgcagatacagtgcaaattttgacgaaagtagaattgaagaatgccaagaccggaatgaagatggtttatactatcgtagccgaaagcgaagcgaatttaaaattgggcaagatttcggtaaatactccgatagcacagggtttgttaggaaaaaaagtgggtgatgtggctgaaatcactattccgcagggtaaaatcagcttggaagttgtgaatatttcattttaatatataaggcaggtccgctatgcggggctgccttatttaatacttatagatatggcaacaatatttagtagaattattacaggtgagattcctagctataaagtggctgaaaatgaccagttctatgcttttctggatatcaatccgttagccaaagggcatacgttggttgttccgaaatgtgaggtggactatatctttgatttggaggataatgaactggctgctatgcatgtttttgcaaagagtgtggcgcttgccattcaaaaggtttttccgtgcaagaaagtaggtgaggcagtaatcggattagaggttcctcatgcacatattcatctgattcctattcagaaagagtcggatatgattttttctaattcgaagttgaaactgacaaatgaagaatttgtggaggtggcaacagcaatcaatcaagcctgggaaggtggtgacaagtaatctttttctttcttagtaaatataaagagaaggtgtgtcgtaatacacgatgcgccttctttttttcattgactataaaaatcaatactttgtgtatgaattagttggctgattttgtaatatttaatgaatgtccctaaaataaagaaactacatacagatagactactgctgccgggattgcgagaatcgcgctgtcaaaacggtcgagcattccaccgtgtcccggtaaaatattgcccgaatctttgatgcctagacggcgttttaataaagattccgttaaatccccccaggttccgaatactaccactgtcaatgctagtccgatccatactccggtagacatgaaagggaagaagtgagatagcaggaaagaagctatgatacagaaaatgccgccgccaatagagccttcccatgacttcttaggagagatgcgttcaaatagtttatgtttgccaaacagcatgcctgtacagtaagcacctgtatcattcacccagttgaatataaaaatagatagtgggagaatagcgttgtattgtgaaaggctggctgtttcgtccgaatggaaagccaatacattcagcaaagcgaatggcaaggcaatatacatctggcttaacatggcataagcccaattattcagcgggttttcttttttcaaataaagttcgctgaccatcagataaataaataaagctaaataaggaataaatatacctgtttgtgaaggatctattccaaaatagaaaaagcacaggaaaagaaaaattccgctgagaatacatatacgtttatttacttgtattccttctacatgattgaccaaattacagaattcattgattgccaatgcgctgataatggcaaataggatgccgaatgagacagcccctcccacgatgcagcctatcagtactgcaacaaaaataattccggttatggcacgttgtaagaaattgcttttcacggtcgttagtcttaagtgattcaaaaatcaaagtagaagatctgttttttttatcattctgagtgaccatgaagaacccggatatatctggattattacggactctttgtatcattcagaatgacaatgcttatatagttgacagatctttctacaatgttatgcttcttttttttctttttccttttcctcagaatctgaagaattcttctcttcaaaatcttcggttacttctactggttttgctgtagcttctaaagccataatttcttctgaacgtgaagtccaggggcgtttgccaaaaatgcgttccacatcttcggcgaaaattacttctttttcaaccaacagacgggccagctcgttgtgaccatctttatgttcggataatattgcttttgcccgatcatattgttcgttgatcattcttttcacttcttcgtcaatcagttcggctgtacgttcactgtaaggcttgctgaaagagtattcatcgttgctgtaataacataagttgggtaacttttcactcattccggcataagcaatcattccatatgattgttttgtcacacgttccaaatcgttcatggcaccggttgaaatatgtccggtgaacagttcttcggctgcacgtccacctaaagtggcacacatttcatccagcatctgctctttggttgtgatctgccgttcttcgggcaaataccatgcggctcccaatgcacgtccacggggaacaatggttaccttaatcaaaggattggcatgttccaaaaaccaagacagcgtagcgtgaccggcttcgtgtaaggcaatagtacgcttttcttcggcagtcatgattttggttttcttttccaaaccaccgataatacggtctacagcatctagaaaatcttgtttcccaaccgcattcttaccatggcgggcggcgatcagtgctgcttcattacatacattggcaatatctgccccactgaatcccggagtttgacgggcgagcaaatccagatcaacactttcgtccagttttaaaggcttcaaatgtactccgaatacttctttacgttcgtttaagtcgggtaagtcaacatgaatctggcggtcaaaacgaccggcacgcaataatgccttatccaatatatccgcgcggttggtagcggccaaaatgatcacaccgctatttgaaccaaaaccgtccatttctgtcaataattggtttaatgtattttcgcgttcatcatttccacccatgcttggatttttgccacgggcacgtcctaccgcgtcaatttcatcaatgaaaataatgcaaggagctttctctttcgcctggcggaacaagtcacgtacacgggatgcacctactccgacaaacatttccacaaagtcggaacctgaaagcgaaaagaaaggtacatccgcctcaccggcaacagcttttgccagcaaagtcttaccggttcccggagggcctaccagtaaagcgcctttaggtatcttacctcccagctccgtgtatttctgaggttgtttcagaaactctacaatttcctccacttcttgtttagcttccgcttgtccggctacatctttaaaagtaatccggttagttttgtctcctttttcgtatacctgagctttgcttttacctacgttgaacggattggcacctccggctcctgctccgccgctcatgcggcgcatggcaaacatccagataccgatcaacagtaaaaacggagcgatattccaaaataatgcaccgaagtagtcgcgtttcttttcataactgatagatccggtaaaatgaccttcttcctgtgccttttccatgaatttatccaatgactccatggaacctatttctacgttcaaggctggattacgacctacttttttatagtcatttttaaatacatctttaacaaattccggtttaatgtacatttctaccgtattgtcatcgtatgcaattattttattggcatatcccttgtttatcatatctttaaactcggtatatgttatttgtttgtcaattcctccttcttgattggaaaagtagaggatggcaaaactcatggcaatgataacatacagccaactcaaattgaagcgtggcatgtttatctttggtttattattggtattttcactcattttgattctgtattggattagtctagatcaggaatttgggttagtttggcatctgcccataaatgttccagattataaaaatttcttgtttccggcaaaaagacatgtaccagtacatcactgtagtccattgcaacccattctgcgtttctcagtccgtctattcccgtaggtttgtcatttatttctttatgtacatattccttgactgagtcaacgatagctgtaacttgacttggggaattaccttgacagattacgaaatagctgcaaatggtatcattaatggcggtgaggtccgctattacaatgtttttacctttcttttcttgaatgccttctgttattttttttactaaagtctctgcttcgttcattataatgttattaacaactgattattctaatatatgtatttacaacaatgcacaaagatacttggttttctcattctagcgaaaaaatgtgcattaaatatattcggtttttgttttttttagttagagaatctttttattgttatgttaagtctagaatgatgatacacggtcaagaaggataaggaaggccggaaaagaaggcaaatggagaaaaaaagaatcttgattagaaaaaaaagcttcaaaaatttgtggattaaataaaaagccgtatctttgcagcgtcaaaatcaaaacgggtgttttgataggaaaattgggatatggtgtaatggtaacacaacagattctggtcctgtttttccaggttcgaatcctggtatcccaacagacaaatcacttgtcaaagacaaagatcttctaaaattataattttagaagatctttttttattttgtgttggttatcttaagaattaggggtcaacgtaacaatctgagggattttatatttaagcatataatttagcaagtcgttccgagctggtcggtcagtatcgagtaggatctgccttcctttatcattgccattggcacgaaggactcctcgtcgaagagccataccgtcatgtcgcggcgttccgtgtccgtgttccacctgtcctccatgacggagtattccctgcgctgcttccactggtgcagcggcacgttgccgttccacatccaccgcgtcactgtcgttccgaagctcttggagagcctgcgcccgagcgcgtcgtatgtgaactccacctccctcttgtcgggccgcaccacctttgccagggagccgtcggcgttccaccggtatctccagcggtccttcttgccgtcaagccactttcccgtgccgaggtagcgttccgtcaggttgccgtcagcatcgtactcgcagtgccattcaccgtcctgctccagccgtccgccactgaggtagcggcgcagcttcatgtccgggtcgggatacaggttccccaccgggtcgctctttctccactgctccctgccgtcggggtattccgccctgtcgagctgccccgtcggggtgtaggagtagcgggtctcgccacgcctgctgtcctccacggacaacagcctgtcggcgactccccagcggtagcggcgcatatgccgtgtgcgcgaatccttgcgtgtgcgggcatccaccagacggcctatgtcgtcgtaggcgaacgagcggacgacgcctcccggaaggatgcgctccacctcgaagcccagcgtgtcgtggcggtgtgaggattcccacgcgcccgcgccgtcggcgtcgctgccgccggtggccgtgaacccctcaagctccccgtagccgttgcgggtgtagcgcagcgaggcccccgtcgtgctgtcgagcgtgagtatcctgccggtatggtcgtaggtgcggagtatggtgttgccgtcagccgtctcccgtatgggaagtcccagggagttgtacgcgaattccaccgtgctttcccccctcgatgcctgcaccagcctgccggacagcccgtaggcgtaggtctggtcggggtcgccagccgtggggtatgagacgcgcgtcacgcgcgagcaggcgtcatagccgtattccctttccgtccccgatggcagcgtctccctgatgacacgtccgcccctgtcacgcaggtaatgacggacggccccgtcgaagcccttctcggcggtgacgttccccacagcgtcgagggtaaactcgtagctctggagcttctcgtttgtcacacggcgcaggcgttcctcccggtcatagcggaagttcaccacgccccggtggtcgcgacgccttgtcagtttccacatgccggagtagccgtactccacgtgctggacgttgtcacggtattcggtgaggttgtctatcccgtcgtaggacaggcgtatgtcgttgccgtcgaagtcgagcacgtgcaccatgcggcccacagggtcgtattcccttttctgcaccgcacccttggggttggtgacgctcacgcacctgcccagcaggtcgtagccgtacagcgaggtgttcccccggctgtcggatgcctccgtgaggttgcggaaacggtcataggcgagcttcgtcaccacaccgtaggggtctttcaccgatgccaccgcaccgtcgcggtaggtcatcctcgtgacggcaccttcggggttggtgcggctcaccagattgccggagcggtcatagccgaactcccacgtgccgccgtccggtgtggtaacggatatgggacggttgcgcagcccccccttgccggggtacacggcggacacgctgccgccgcacgggtcggagctgtcggtacagttcccccagcggtcatatttgtacagggtgctgttaccgagcgggtctgtctgtgcgaggagctggcggctgtcgtcgtaacgccacaggtgttccccgccgttggcatcgaccttcttccacacaaggccgccacggtggtggtacaccgtcagcccgccatggctgtcgagtacctcggtcactccctctcggaacgtgagcttatggtcgtatatgccgccgtcgccccacgtgtgtacgcagcgcgaacccacgcccgtaccgtcgtactcgaagtaccacgcaaggccgttgcgccatgtctccttcacgatgagccttccggcatactcgtatgtcatcacgtcgcctgccgcattgcgctggagggtcatgttgccgtcggcgtcgtactcgtaggaggcgagggtaatctctttctccggatcttccggatgcgggccgtatatctcaaggatgcgtccgttcctcgtgtcgtgttccaccctcagacggcggcccgcactgtctgtaatggagtgtagcaatccctctttcgtgtactcgaagcggatgccgaggccgttgtagtcggtcacgctctcaagcaggcgcacggaatcgtactccttgcgggtgaagcggtagtagaggtcctcggccatgtcccacacgcagtagcagccgtcctgttccagacgggcttccttgcgctcggagaggatgaacgagggttctttcgctgtcggcagcgggaaggccaccgggatgccgtcactcatgcggagcgtcagggtgccttcttccgtgtccgcgacgacgcccatgtcgtaggcgtggtgccacccgttgcccagaggcccccggtagtcgctgcggctgtaccatgtgcgctcccatgacagaggcaccgggccgtcgagccagaagtcctcctcgtcggtgaagaacgtgccgctggccacgtccacaggatgccccgtgaccgtacagatggccttgtggagcatgttcttgagggattcgctctttatcgtcttgttgaccttgctgtgcagcttgtccgccagcttcttggtctttttcttgtagaaacgcccgaacgcccccgtgcacttgcgggcgagtgccgccatggggttgagagggacgggaaccgggctggtgagtatctgcctggcggggggtatcgggttgatgacacccgtgggcaggaacattcccggaaccttgtgcacgctcggtatgcccacgtcgttgcagtcgaggtgcaggtgcgcgccgccgcccgagaagggcatcccgtcggcgagcaccgtcaggctgcccatgaaggcgtggccgttgttcttgggtatcgccgctgaaggggccgcccagcctgcgcccatggggatgtgcgggatgctccgcgtgggtgtggatgcaaccgcgcgggggatgaagccgcctatcttgacggtggcgcccagcatcccgacggccatcgtcagcacggtgtgccccacctcggcgagcttcgcgctgtcggcgtcgcccgtctgttccgctgtcggaggcggggggatgaatgaagagaccgccgccgcgatgaagtcctgcggacgaaggagaaccccgacataagggtgaggcatgggcacgacgggggacgggggtatcgtcacgaggtggatgtccacaccgatgaccgggtcgagctgcttggagatgggcaggcaggccatgcccttcatgcccatggcacccagcacggggagcatcgcggcctcgctcaggccgtcggcaaggccgccgatggcggctgccgccttgacccccgtgtcgagggcattgacggacggtgacacgccggcgtcggagttcgccttgacgccttccgagatacccttgacctgaaactatctggaaggcatctacggatgccttgaaaggatcgagaagaaagtggagatattgtcatccgccccggtagataaaaataacgcggtaacgggcggtgagaccggaattgccatgttacgggaaatcagggacgggcttgaacgggatttgaacggaatccggaaatcgttcagccaatatgccggaacgctcctcgccgtcagcaaaagcatgcaggacgtgtccggcaggaacccgttgccggacaggaccgctgaaatcctggccgggataagaaaaaccggggagcagacctcggaggagatcaaggccctgctgaagacagccggtgacaatgcaaagatccgcaacgagcaccgccatactgtcagcatcgagtccaaaggtatactttggactttcaccgggatgttcgcgatggtcaccgtcctggcagtcgccctccatgcggccagacagccggactacgaccgtgccgacaacgacctgaagtaccgctacatcaggatgaagggcgaagcatcgcctgaaaatatctccggactggaaaatattttcggattcaaccgtgacaacggcaagataaaccaaatgcgcaaggatgtggaagcctacgaggaagcggtacacgagcgggccgcccttatcgagcaggcacggttaaaggagcgtgcggcaagggagctgggaaacaaggccgactcgatcaggggcagaaattcaaaaaggcggagatgatatggcaagggtgaaagtcaaattccgatcgtcggcagccgatggctgacaaggaacggtattttaccggatggtacataaccgcatggctcgccagcaaaagacgggctaccaccttttgataattttgcattctgtataattttaaatcagagagtttatggctacagtaaaaattaaattcagaccttcttctgtggacggcagagagggtacggtttattatcaagtgattcacggacgtgtggcaaggcagatcaacacctcttgcaagctgtttcctgccgaatggagcaagcggcattcccggattgtcatcgcgtcatccgatgaggacagacgacaatatctattgctattggataaaaaaatagcggaagataccgaccgtctggagaatgtcatcacagctctggaacggaagggaggtactttcaccgctgatgatgtaacctctgccttttacgatggacattgcgggctgtctttttccgtatttatgcgggaggtcaccaacggtctgaaacgcctgggcaagatacggacaagcgagacctacacctctacccttaacagtttcatgcgtttcatggagggaagagacataccgccctgtgatatggattccgacctgatgatcgcatacgaggcgtggctgaaatcaggcggggtttccatgaacaccatctctttttacatgcgcaacctgcgggcggtatataaccgtgccgtggagaaagaactcgttatccagcgtttccccttcagacatgtctatacgggagtcgagagaacgacgaagcgggccgttcccctgcgtgcgataaaacagctcatgacattggacctgtcacttcatccggccaagaggtttgcaagggacatgctgcttctcagtttttacacaagggggatgtccatgatcgatatggtgttcctgaaaaagaaggatctcaacaacggcatcctctcataccggcggaaaaaaaacggtcaacaactttttgtaaaatgggagccgtgcatgcaggagatcgtggaccgttacaatattcccggctccccgtaccttcttcccattatcgccagaccgggcatggacgagagaaagcaatatatcaacgcatcccatcgtatcaacagatatttgaaagctatcggaaaagaactgggcttgtccgtccccctgacccattacgtcgcccgtcattcctgggccagtgcggcccggagtaagaatattccgatttccgtaatcagcgaaggtatgggacatgattcggaaaacacaacgaggatctatctgactacattggacactgccaccattgataaggcgaacagattgattttaaattccttatgcagggaataacaaacatatcgagcggacagacgctttcttttcgagagaagtgaaaaaagaatttcctgaataaggaatacttgttcaaggaataatcttggatgtaagaatattcagggatgataaaatgttaagcaaaaattatgatctcttcgtaagagatgaacaatgcgacatatatgaataaaacagtctgataataaatactttgccttcttctaaaaagcagttcgctcaacaatccgttttgcggttttaaggatcggctcgtgtcccattgttatttttttactcattttgtggttattctcaatatttttcgtaattttgcatccggttattcatctcttacgaagagaagtgcaacagaagcaggtgcaaacgcacctgaaaatccgccagatataatggcaaacagacgcagatttctgatcgggaatgaagcaatggaacaagaacagggagaaatcccgaacttttacgaactgtatttataactgcctgattgatagaaatattcacaatcttgcaggattgataaatatgtcctgaagcgaaatggcggcatttacaaggatcgaaaaaggaatgaggtggtacgtaatgcgcgacttgaaaagggcaaacgccaaagtacccgcttataagctgctggaagaaatgaagatggaggtcttcgttcctatgaaatggcacttggtcacccgcaagggaatgcgtatccgtgaggaagtgcccttcatacaggacttgctcttcgtgcatgaaacacaaaacaaccttgacgccgtcgtggaaaagatacctaccctccagtaccgctggctgcgtggcacgtggcgcgagccgatgacggtggctgatacggacatggaacgtttcatccgtgccgtggatgccactgaatcccccaggtattacctgccggaagaaattaccccaaccatgtacgggcgtaagatccgcattgagggcggaccgctcagcggatacgagggaaggctgctcacgacacggggctccaaggtcaaacgcctgctcgtcgaactggaaggatttcttgccgtaggagtggaggttgatcccgagtatatacaacttatctgacagaactgcctgtggctttcatttccaatttttccgctccttctttatttgaaacggtcgattctattcaagcagccgtatgttgatagttaaaaccaattggatttgataatgtttttttgtgaaatatttacttatttaatataatatattatacaataatttaatactaacagaaaagtgtggaaacggcattgactttttgggcactctttgaaacttgcaaaatgtaggacttaacgtggaggaatatgtctcaactacaatgaagcagctgatgtccggcaacaaggaatatgacgctcacttgttatctccatgattgttgacgcataatcttactaaaattaacatcaatgacatatcttcctaaatttaaataagacagagtaatttgagcaattataatttatataatttacaagaagtaatacatacaatgaccatagcagtagactttgacggtactattgttgagcacaagtatacatacaatgaccatagcagtagactttgacggtactattgttgagcacaagtatccggcaatcggcagggagttgccgtttgccattgagacattgaaaaaattgcgtgacgaacatcacaggttgattctatggacagtgcgtgaagggcgtctgcttgacgaagctcttgccttttgccgtgatcgcggtcttgaattttatgccgtgaaccgcgactatccggaggaggagaaagggcgtaacaatcattactcacgcaagctcaaagccgatctttttatagatgaccgcaacttgggaggccttcccgattggggtactatttatggaatgattcatgacggaaccactttttcggatttgatacgtagtgccggtgaatctcctgtttcggagaatcacggcagaggtcttttttcgcgcctgtttggcagatgattgaataataaatgaaaaaactgatatgaagactttaaagaaactattattgtttgttgtggcatccgccttgttggcaggctgcacctcctataaaaatgtaccttacatgcagaatcccgaggtagtgaacagttacagggaagatcttcccctttatgatgcaaagattatgccgaaagatttgctgagtataactgtgaacacgagtgatcctcaggctgccgctccttttaacctgacggtacagactcctctgaatgcagccctgaccaatattaatactaccacacaacccactctccagcaatacctggtaaataacaagggtgagatagatttccccgttatcggtcgtctgaaggtaggcggccttacgaaaaacgaggcggaagatttgatccgtgagcaattgcagccctatctgaaagagagtcctatcgttacagtccgtatggcaaattacaaaatttcggtattgggagaggtgaaccgtccgggtacttttaccgtaggaaatgaaaaggtaaatatccttgaagcccttgccatggcgggagatatgactgtttatggcgtccgtgacaatgtgaaactgattcgtgaagatgcaaaaggcaagcgtgagattatcaatttgaatcttaataatgcagagctggttgtatctccctattactacctgcgccagaacgatatcatctatgtaacgcccaataagacaaaagccaagaactcggacattggcagcagcaccagcatgtggatcagtgctacatccattttggtatctcttgcaagccttctggcaaccatcttgaaataaaaactcataaatataattgttgattacaaactgttgatatgactgacgaacagaagaacaccccttcgggtaccgagcaacgtgaggagaacgttgatctttatgccttgttttttaaatactttgcctattggccgtggtttgtagccagtgtgctggtttgtattatatctgctttcatctatctccgttatcaagctcctgtctataatgttgatgcggccgtactcatcaaagaaggtgacaagaaaggtggaagcagtaataatcctatgggagcccttcaggatctgggtatgttctccatgactaacaattttgacaatgaggtggaaatcctgaagtcaagaaccttgattaaaaaggtggtgaatcatttgaatttgtatatttcagtggccgaggaacgtatgttcggctataacactcctttatataagtccactccggtaaaagtttatatgactcctgaagaggcagacaatctggaagaaggagccaagcttcatctaaaatacaccatgaatggaaaattggatgtgaaggtggaatacatgcttgacgaggaggagcaggagactgaggtaagttttgacagtatcccggctgttttccccactccagtaggagttttcagttttacaaagaacgactcggtcccacctttggaagaagatatgaatctggtagcatacgttaattctcctacagatgtgacggaaagttatgtagagaatttgtcagtggaacccacttcgaagactaccacaattgctgccatcagcttgcagaatacggtaaagcagcgcggtattgatttcatcaattgtctggttgacttttataatctggacgcgaatgacgagaagaatgaagtggctcaaaaatccgcagagtttatagacgagcgtattggcattatcaatcgggagttaggtactgccgaaacggaacttgccgatttcaagcaacgctccggattgaccgatttgaccagcgatgcccgtctggctttggaagagagttcgaaatatgaacagcagctgaccgagaatgccacccagttgagactggtggagtccttgcgtaactatgtgaacaatccgaagaatgcaaacgaggtgattcccgctaatgtagggttgcaggaccagaatttgggttctatcatcaaccaatataacacgatgctgatcgaacgcaagcgtttgctccgtacctcttccgaaaacaatcctgcggtaatcaatatcaatacgggcatcgagtccatgcggcacaatgtgcagactaccgtgaacagtgtactgagagggttgcagatagcgcagtccaaccttgaacgtcaggcacggaagtttgaaggcaggatcagcagtgcgccgcagcaggagaaagaatttcttactatctcccgccagcaggaaatcaaggcgaccctttacattatgttgcttcagaagcgtgaggaaaacgcaataaccctggcatccactgctaataacggacgtatcatcaaagctgctcttcctagtaaaaagccggtttctcctaagaagaagatagttctgctggctgcctttgtattgggtatgggtattcctgtaggtcttatttatttgaaggatttattaaaatataagatagagaatgctgaggatgtggagaagataacggatgttcctattttgggtgagctccctttaagtaagaagcccgaaaaaggtgccattgtggttcaggagaatcagaacggtatgatggaggaggcttttcgtggtctgcgtaccaatatgttgttcatgcttggtgccagtcagagagtggtgctttttacatccacacagccgtgtgaaggcaagtcttttattgctggaaatacggcagtcagtctggcctatatgggtaagaaagttgttattgtgggtttggatatccgcaagccggggctgaataaggtctttaatctgtcccatcgcacggaaggtattaccaattatctggctgaccccgagcataccaatctttttgatatgatacaacattcggatgtaagtcctaatcttgatattcttccgggtggtcctattcctcccaatcctacagagttgatggcgcgtacggtactggaagatgcaatagagaaattgaaagagcgttacgattacattattcttgatacggctcctattgctattgtgaccgatactgctattgccagtcgtgtggctgatatgtgcgtgtatgtgtgtcgtgcagatgtaactccgaagttggggtatcagtatattaatgtgctgcgggatcagaagaaattcgataaattggctacggttattaatagcattgatttgaattcaagaaagagtggctatgggtatggtcataatgaaagctcaaaaaaaaagtcggcagaaagaaaaggccatcccggaaaggggttttaaaaaaaggtctttaaatctagctgaagcataaaattagaagtttaacaatcccaaaaaacaacgagttatgtcacgagtacactatttagaaggagattatgaacagttagttattaatgaaacgatagacggtcttttttccagttatcgtatagaccgcaattcattgccaaaaggatttttcctttatgagattagatgggatgacagcttatcttcattggcagagattagcccctctgtggtggtgaatcatgcaggttcattcattacaaagtcaccccttgaatttgatgcaaacaatagcatacggataacctataccaattttatcgagttctgccagtttggtgagtgggcttatgagaaactggctgtattggattgtaattccggtaatgttgcggtgataagcccagacaggagattgcagaccactgaagagattgagatttttttgagtgggcattgtggctatcatctgagtgagattaattggatggtgatgaaaggcgatgtgctgtttttgaacgagaacgatttttaatgagtataaccgtaactgcctcttggaatggggcaattacataaaatattataagtatgaagtggatagataagatggtagaacgcattacccgaaaagaaactgctttaaatgaccacttttgtgtaaatcggcatacggttgtatgtcagagtggtatgactgattatgtttctgtaacgattgataataccgatggttttgatttcgatttttggacaaaacaactttgttttgagaaggactgtaaatatcgttcggagataaaagcggcttttgataaaatctatggcacaaggaatatagaatgttgtgaataatgaagtcagaaaagtatgataccaaaggagataatgaaactttatgaaaagcttgctttcagtcggggatatgaagaagcctttcgggattttttggatgtttgtctttactatttgtctgtcgggatgttggcggaggattatcgtagagtggaaaaaagatataagccatatgaaatggaactttttgttcaaatgttttatagggtgtctgaatattcggaaggattttgcgatgtcttgggagatatgttcatggagtgtgtcagtcatgggaataacggacagttctttaccccgatacacgttgctgatttgatggcatgtatggggggaaataggctgaaacctaaacagtcggtctgtgattcgtgctgtggttccggcaggatgctactttccgctgtaaaaaaatgtgcggaagagaatgatggaggaaggcttttttgttatggctcggatatagatttgatttgtgtaaagatgaccgttgtcaatctgatgatgaatagcgtacccggtgaagtcgcatggatgaatacattgacaatgcagcattggagaagttatcatatagatttacagctgatagccggagtatggttgcctattttaaagataacggaagcaggtgacacttcttttattaggaaacttgaaaatgcaatggaggataattctgaattgaagaggtcgattcagagcaacgcaagggctacgcagctgacttttgatttttgacaagataaatatgtaaaaaggattttggtatgaaagcaataagaacaaaagaggtgaatgagaacgtcaaagcggcgaacagttgtttgcgtaaagcgaaatggcaggctaaggaattggctgtttttacaggtgaagtagtgcgtctgatggataaggaagggcattctctacaagggttctttaatcgggtggagtttgttctggtggacggcactattaaattccgtgtagttataaatcctattcttgaatgtgagaactgtataatggcttcttgccatgaagactatctttatgaggtggtctcggtggaaaagtttacctataaaaattataggtatcatttgtaatgatattgtattttaatgattataaactgatttatattataacaatgatgggcaaaattaataatattcccgttttgaatgaagatgttattcgtttggttgtactcaatgaggaaattattgggtatatctatccacgaaggacttcttatgtggtggcattggagataaagccgggacgtactacctctttggctacatctgtcaataaacaatgcatggttttgttgagtgataaggttcgtttggccacggaacaggatttcgatgattttcatatatgctttgatggtttcagaaataacactatgtattgttataatcagggaacggaacctatataccttcaatgaagcacattctcccttcttttggattagggaagggagggtattttgctgtccgctactttttggcaagcaccccaaaaaagtagcaaaaaacgcttggagttactggtaatcccattaatttgcgttcacgcagtattctttcccaccctccccttcatcggaatgactgttctcattcccggtttacccgtaatcatccgctatgcggctgattatgggtaaaccggaaaagagaagttcctgtagatactaattgaaaagtgcgctgtattctaattgaaaagagctccatccataacttgttacaaaattactataagtttaaaatattcatttatcttgtctcattttttgtgtttccttaagcctataagacagtccggtcatattaaccagataagctttatgtgtaagcctgtcaaccattgccgccacaagcaccttgtcctttatgatttcattccatctgttaaaagccaaattagtagtaatgattgtagccttttttccggctcttaacgacaggtggttaaaaagcagttctcctccttccttgtcacaactgacatatccgaactcatcacagatgaccagatcgtatttttcaaaccttaattgtagcgtcctcagtgtctttgctgatttagcctcccttatctgggtaagcaggaccggcactgaagtaaacaatacggtaaagtcctgttggcaggcctttattcctaaagccgtagcaatatgcgtctttcccgttcccggatttccatacaggaccaggtttcttccctgtctgatgaagtccagtgtctccaattcaggtaatattacctgtgcctctttgggcatgtcttccataacaagctcatgcagatacttcatttgtggaaatcccgcagatcttatccttgatcttcttctacactcccttctcctggcgctttcctttccaagcaattccgtcaagaactgcagatggttccagttttcttcagctgccaatgaaagggtgcattccagttcctctttaaaggccagaagcttcagttctgcagcatagtcataaatggtttctttttctgatttcatatattataaacttaaatggttggtattatatcatgcacttcattgtatcctgtcatgagcgccgtgatgccttcaagcatatccacagcttctctttctatattctcctgttgtgccgggagaacaggcggttccatggtttcttctgtctctccctgtacgctaccatgcagcatggcctttacctggtccggagatatctttctgacaccacgtccggtcagctccttgcatgccgtgacaatgtccgttccggaaaatccattttttcgggcatagtccagcaacagaacaaacgtcctgttgtcctccttgaaatggatgtcatacagccttctcagttcttccggtgctctttgccaaaccacagagtggggcaatgcccccggtttacgggaaagtgtacgcaaatagtgctccagcttgatgcaccagtctccaccgcaataactgcgttgatgagaggccactttctccttcccgtacaggatgacgattttttcactataaaccttgacatgtactttttctcccacaagagaatcaggtacggaataatgaacatttttcatgctgatagttgaccatttatccacaatgtactcatagacctcaaaacagcccagattaccgggaaaaggcttcagcgatgacaggtcagcttccagacgtgatgttttctccgctgttgaaagactgccttgctcgttgttgacctgcatacatacccggtttaaatgctcctgggcagaatgtatatcaccaaaatggtctgtcaggcagaaagctttccttctgacatattccacgctgcgctccacatgtcctttctcccatccggcccgtacattacagaaacggtactcaaaacaatagaaaccggacatcttcatcaaagcttctgtaggtttcttatcaccaccgacaaagctcttgacggctacacgcatattgtcatagaccatcatggcggggacaccatgtatatccctgaaaaagttacggtgggattccatgaaggcaagcgtattctgatgcctgaaaagataggcgtatctgccattgctatgcccgaaagtgaatacggccagataaaacttggttttgacgccgtcaataaaaagaagaacttcaccccagtcaaactcggcaatgcatccaggctcatagaacaaccggataaaggcttcgctctttttcttctctttgtatgactctatattttttatataactgcatactgtggcgtaactgatggtgtatccttgagataacagaaactggtggatatcctttttcaacatgcgctgtttgcgaagtccggtagctatcttaacggcattcttcttcaggcaaaatcctatcttatccttaatctcttgtgtgagccggcgaggacggcgtctggaactgtcatacctgggctggatggtaagcaaatcactcaaagcctcttctggattgtccgtgcggatggctgattcgtactttgaaagaatattgtcaacggtatgacggctgacatgaagttcacgagagatacgccgtttgctataaccgcatactctatacatgtgtattattgattgtctttctaccatagtcttcattttacctttgcatttggattatacaaaggtcattatacttatcctatggtggcgcaattttcaactggaatattggcgcacttttcaattagtatctacgtgcgacacgaagttgcgtaaataattgttcaaaattctaatccacgagctggaattgaatgattgaacccgttgttccgtcaacggtagcctacggacagatgcaccaatagtgataattctgtatcaagctgtccggacaatgtactccttccgaaaggaaaagacaaaaccgtaagggaaagacaataactcttagtatcatagagttgggaggctaggcagagtagtatggttaacacatgtgaatcgttgtttgaatcgtcgttaaattggaataagccaaagatactgaaaggcttgaactaaaaagtatgcagtcggataactctctctttgattagggttacacggacataagcactgccggcgaagagacggaacctaacctactcgtatgttatttacacgaaacgtggtaagcctgtatctctcctgcaaatgcaggtaagcaaaccgtaaggaaagctgaacggggtgcaggtataggattgcagaaaaagcgaacgccatccttgtaatgaggaggatatgtggttgagccatcatccatgaattggacaaggcaacattaccctacacgaaagtgtgctgacttctgcgttaggtaattctttacaagaaacttttagaacttttgaaaggagaaaagcaaatgaacgaatcaaaatcgtgtgcatctactaactcaaaatgggacacttgggaaagcataaactggaccaagtgtgaagttgaagttaaaaagctacaagctcgtattgtaaaggctcaaaaagctggcaaacataacaaggtgaaagccttacaatggatgctggtacactcgttctatgccaaagcattggcggttagacgagtgacttccaataaagggaagaacacagctggagttgaccatgtcttatgggcgacttcacatgggaaaatgaacgcaataactgaattaaggagaagaggataccgtccacaaccgttaaaacgggtacatattaaaaagaagaacgggaaactccgacctttgggaataccaaccatgaaggacagggctatgcaagcactatacttaatggcattagaccccattgccgaaacgactggtgacaactgttcatacggttttcgcaaagaacgttgtgcccacgatgcaataggacaatgcttctgtgtattggctaaagaggcttctcccaaatggattttggaaggggacattaaaggctgttttgatcatatcagtcaccaatggcttatagacaatatcccaatggataaagtcatgctaaaaaagtggcttaaatctggatttgttttcaacaacaggctgtttccgacagaagagggtactccgcagggaggaataatatctccaactctagctaatatggctttggatggcttacaagcaaaactatcagaacgctttatcaagataaatcatcatagagatacctattatcccaaagtacatttgataaggtatgctgatgactttatcatcactggaagaagcaaagaaatgttggaagatgaagtgcttcctttagtaaaggagttcttggagacaagaggacttactctatctgaggagaaaactaagattacccatatagagaatggtttcgactttcttggcttcaacatcagaaagtataacgataagatgcttataaaaccgtccaaagaaggagtcaaaagatttttggacaagattggagagcttgttaaaggcaatccctctgtaactcaaagttctattataaggcttctaaatccgataataataggttgggctaactactacaagtatgtagtgtcctctgatacattcagtaaagcagactatcagattttccacaaactatggagatgggcactcaaacgccatcccaaaaagagtaaaacatggattaaaaagaaatacttcagaaaaatcggaacacgcagttggactttctctgtcgaaaataaaaaagacgaggtaaataaaagacatcatgctctaaaatacctcactgacacagaaattatccgatatgtaaagatacgaaatgaggtaaatccgtatgaaccaatggataaagagtattttgacaaacgagagacctacaaaatgcttttaactcttaatgggaagaaaactatccttaaaatgtgggaaagacaaaatcgaaaatgtcccatttgtggcaatcctatcaataaagaaatgtcttggtatatcaaagaagacattgtagaaggtaaaaaggttaaaaccctgatacatgatagctgccacagaagtattgttcaactcaataaaaaaaggaaataatgagccggtttctatatagaaatttagaattgcttgagccgtatgaggggaaactctcatgtacggttcttaggggggaaagctcccgaaagggagctgacctacccgaccagtaagcattcggcctcgtgcgtgtttttttcccctcttttccttcctacctttgtggcttcattataatcttaatccattatgtgttcagtattagaattttctagcgaaagtgataaactacgtactctcttttccgagtctaaccattttgattctgttcttttcatatttgatggcggccgtcgttataaagtttcgtcttccagccttggtatccattcccctcaggacctacttctccctttaggtcttggccttttccgcagcagtcctttttggtcttattacctttatccccaaggttgtaatttccataaaggtattgacggtctttgtggcgaggtcatccgacacacgggttcctgcgtgtcagagcagagctgtcatatttttcccgaccgctcccgtagcaggttgcatatcctttatcggtgcgacgacgaataccgtctggaatgccgtcgtctgaatcgcggttctttcctcttgaaaaaggaggaacggaagaaggattttcttcaaatttcctggaatcgcctgaatgagctgcttactgttaaaaagtatcggaaaacagttgaaaagtaattccccattctataagccgtgcagttttattttgataactttgccacataataaaaagtggatgtacagtgaaagaaccggttattacccttactttggaagagtacgaagagttgcgcaaggaacatgaatgccttgaaaaggagcatgcggaacttcagagaaaatacgaagcctctttgcaggagtattcccgccaggtcgaagaaatctcggcctgtacagccgtcattgccgacctgagatggaaattggctgacttgacacgccgtttatggggtaaatccagtgaaaaacgtcatcttcccgaagatgccggccagctgagcatctgtttcgagtctccgtccgatgtcaatgacccggtagcggaagaacagaaaaccgctgggaaatccgtcacatcggagaatggctacaatcgtttccgtaaaagcttcacgaaaaagatcactccccacgcccgtaagcccatcgacccgtcccttccccgtgaggagattatcattcccatgccggaaggcctttcgttggagggagcgacgaagctgggagaggaagtgagcgaacagtatgctgtcagccccgcccgattctatgtgaaacgcatcatccgtcctaaataccggctcgccgacggtcgtatcataaccgctcccatgcccgtaatggcacatccccacagcaatgcctcggaaagtgtactggcccacattgctaccgccaaatattacgaccacctgcctctgcacagacagctggatatctttgagcgtgaaggaatccatctgagtccttccaccgtaagtaactggatgatggctgccgcacagcgtctggaaccaatctataatgaacttcgtgaactggtcaaggacagctattacgtcatggccgatgagacaccccatcccgtacttgaaagcgaccggcccggtgctcttcaccgcgggtatatgtggaacttctatctgccccggttccatacccccttctttgaatatcacaagggccgtggcagcagcggaatagacacactgctggcaggacaggtccgggtggtacagagtgacggctttgcagtatatgacaagttcgacacgctacccggaaagttgcatctgtgctgctgggcacacgtcaggcgcaactttgtggaagcggaaggaaatgaccctcccagagcaaggcatgcacttggacaaataggcggactgtatgccgtggaggagaaaatcagaatggaacatctggaaggggaggcggtggtaaagcttcgccgggaaaaatcgtaccctattatcaaagaactggaaaaatggtgcaaggaggaatatggacatacggtcgataaatcgcctattgccaaggccatgttctatatgtacacacgctttgaacaactgtccggatatgtcaatgacgcacagttctgcattgacaataatccggtggagcgttctataaggccgttgactttaaacagaaaaaatacgctcttctccggatcacatgaggcagcacatgcagcggcaattttcttttcactgatgggatgctgtagggaaaataaggtgaacccaaaactatggatgcaggacgtgctgattagggtacaggagaaagaaagagaagagaaaaacgattacaccgatttactgccatttaattggaaaggataaacaggaaagctataataaagtcaaaagccagacatgcttcgtctggcttttgactttattataacttggagagaaacacgcacgaggccgaatgcttactagccattccgataaaggaaactaccaaagtctttgcggaacttggaacatttgataatgtaaatttaccatccatgtcagtaactgtacctacagtagtaccttttactaaaatagaggcgccaactacgggtaatccgtcctcctccgaaataacagtacctgttaccttcgtgatctgagcggttaccaaacctatacctacaaaaaggcaggtcaataacagcattaattttcttttcataaaattctctcttaaagtttaactttacattaatataaattcattcactctaacaaatgacaaaggtatgaataaaattgtaatatcaaacaaattattgtaaaaaacatactaaactgctatatttttatgcttttaggcatttaaaactcacaaaagacgaaaataaacctcatatttattcttttttttaagtcgttaaaaagagaaactttcaatttataactgatcaggtaaacatacattaacctataaatgttaacgaatcgtctaataaatataaagatgagaacaaaatagtaggataatgcttttctacttttctttattgcgtcttattatagaatttcaattaaagaattaaattatgaggaaaatcagttatcgtttcgtttacaatcgaaaaaaaagtttaaatgacagagggaccgctttggtccaagttgaagcctacttgaataaaaagaaagtgtatttttccacacatgtttatttacggccagaacaatgggatgtaaaaaggaaaatcatcaaagatcatcctaaccaagatgcgctgaatggcatgcttaatgaatttattattgaattagagaaaaaagaattaagtttgtggaggcaaggaaagacaataaccttaagcctcataaaagaagagttcaaatcgaatacagatgcttcattcttagggtttgcgcgtaaagaaataatgtcttctcagctaaaagatagcactaagcgcaaccatttaacaacaatatcccttttacaatcgttcaaaccgacaattgagtttgaagacttaacctataatttcgttacggattttgaaaaatttctttatgaatctggatatcaaacaaatacagtagccaagcatatgaagcatttgaaatcttttgttaatgctgcaattaataaaggatacattgatcccaataactatgccttcagaagatataaaattaaaatgaaggaaggaaaacatgtttttttattaccggaagaaatgaaaagattggaagaagtgtctttgacaggaagaaatagttgtctggaacatactcttgatgcatttttattttgctgctatacgggattgcggtattctgattttgtgaatttgaatgagaaaaatatcgtaaaaatggatggaaaattatggctaatctttgactctgtcaaaacaggtacagaagtgaaattgcctttaaacttgctgtttgaaggcaaggctttaactttattacaaaaataccagggaaaatggagctcatttttttcaattaaaaataactcaagtgtaaataaagagctgatacgaattggcaaattggcaaaaataagcaaacacttttcattccattctgcaaggcatactaatgctactttattgatatataaaggtgctaatataacaaccgtgcaaaaattattagggcataaaaaccttgctacaacacaaatttatggagaagttatgggaagtacaattatacgagacttgaaaaaatgtcaaaaaagataattaactctattgtctatacattatctcttataaagatgaagaagaatcattttcaaaagtgaatatagccttatcttcttaataaagtttatcgttttgtgaacatgataattttttgttgtgattgcaatacgataaactaaaagaaataaaatgtgacaatatttccatctcagcctaaccgggtagaaaataagtatcaaggttattgaatttctgcaaaattcatatatgtatatcatataatatgcgcatataaaattctatatcagaaaatgataataatagtttgctaatttacttcatgtcctactatcttcttttgtaatctaaagtgcaaacaatctttggaagttttgaaatatttaaaaagttgaaaaatatcaatcttagtatttcaggtattttatgaacagagtaacaacgaacaggaatgctgcaagtcaattcttttttcagtagaagaaaggtagaaaattattattatcatactctttaaacggcttaaatcaaggaaaacgaataagagattcagtaatacatatactggttatcaattatttacataaataattagttccgcaaagactttggtttaacagaaattgtaataagaatagttgtattttcttcatttagtttatgtgttttgatttagatatgttaataatacttctacaaaatatcatggcatatgaagtgattatactctatcatcttcatatgccatttttattgtcatttttctgtatattctattatacttttatcgggcaagacataaaatctcagaagaagtctgctgacctcttctgattctttcagtaaacttatatcatgctgctttcaccgttttgttcctgatcctgtcaagcatcagtatggcgttttccgtatgtattccgaagaaaatccgcaggatttcccgcttcctgttccttgcctttattcttgcgagcgagtaatgttgcttttgagtaccgaagcttccttcaagccggtggctttcttttgagagttcacttctaggcacctggctcatcttttgccgctcttcccttgcgcacaaaggatgtggatattccatatcttgtacagaactttctgttggcattattggcatatatggaatcggcagccagacatcttaccttaagccttataccctcattgaacgccttgaacgagagatgctcgatgaacgatatatcgtctatctgtatattattgacctttgcaccgaactcgacggacttgattcccttgcctctgatgatgggacgtacataatgacggttaatattgacgatacggtcactgacttttcgcccttcaaacatttccttttcctgtacaagaaccttcctgatgatggaaagatgtttatgataatcttgggtatatcggagtgaggttccgtactctctatgaatttcacccctttgattgaggagtttttcaaggagtctgatcacgcttgagcattcttgtccttgaagctctcctctttcttttcttgcagtaggacagataggattccgccacattcctgtatttgttgcgcggacgccttatgccaatccctgcaatatatgcctgtagagccattcgaggctttcccaaaggagtttcatgtccgtaagaaaatgcatatggttctcatagcatgtggcatcggtcatgcagacgtgaaggttatcaagataaggtttccagtgtgaagctaggatctcttggaagaaatcaatgtcaaggtgggatgctgtcggatgcgacgaggatgccgaacaaatccgtggatccccgccttttcatgagacagggagtggctgtctgcctaatttttcgcatctgggtaatgtgcccacagttccttgtaggtctcggcaagtgcgcggtgagcttcgtcaatcactatcaggtctgacctgtcattttccacatcctcccaatggtgtgacagccattgggaggaacagaccaatccctcctctttccgtatgccgtaccgcaccaccgtatcttctatctgttctaccagttcacgacggtgggtggcaatccacacactttgcctttgccgttcttgcaaatgctcatgaatgaccgacgcgagcgaatggagtttgcctatacctgttggcatttgtaccatcatgtttttattcaacctccacgtatcagacacgcatagcctgatgctctgttggtaagggcagagaatgttggaataagacttcattggatattgtcatcagcgtcatcctttgaatccactggaacattccacggcacatccaagaaacggtgtcttaaaggaaggttactttcattgtccacgcagaaattttctatatcataaagtgagttcgtctcaaattccatcaagtcctttatccgcttgtcaatgtacccattgtttatcttgaaacgctctacggccaggtcaaactgtaccgtgtcgttcttgagatcgccgtccacataatacatcttggacatcatgtccttgtatgccttgccttccctgtggacttctatcgtacttctgtacgattttaatgccatctccatggagtataaggcttgaggttctgccattcaatccaaggcaactgctccccactcaacacaagatatattttattaaaagatagtgacaagaaacggaaactatcctacttttcatggaattatgtataaatgacaacaaatttagtcagaaatcatttcaatagtaatgcattgattattacctaatataacgtgagttcgaaataagaataaatatatttcacttataattagaaacatagcgcatagacagataatatcctttctttatatcgggatattccttgaaaagaatttcagcccgtattctttgagactgagtccataaggattccttcttgtaaagcagataaatacttctcgctaacaactgctttcttgtatctccattagcgaaaacaggtgcatgatacatctttccacaggcctttgcataagcaagctgagtggactcttcatccaaagcctcccagcgagcttttacacgcatctcctgcacagcttcataagctaacttctgtacgtgaaagcgatcggtaacacgtttggccgcaggaaagcagatgcgtgcaatctgctccatgttagaagccatatccaaggttatctcgcgcacttggtaacggcggcgacgggagagcttaagcaggacagaagtgaccgtatgaacgtccgtacctttaatgatggcaatcatactacctttaccaccgtgagcttctttattggtcagtacagtatagagttccccacgcgagagggctacctcatcaatacagatataagcaccgatattcttttcgaatagtagccaatcctctgcatgaacaagttggtcccaatggagataaccacttagatggttacggtattgacgctccaataaatccccgtcaactccagataaaacacctaagagcttgcaactgatcggatagctatcaatatagttcttttaaaaaagacgcaaaatcctgcgtcatacgagtaccttcagccaccatacgccagttacgagagatatactcattatgcttatttaagagccagcgacgacgacgaatattaaggaagaccttcttgccacggagaggaaaatcttgaacaataacagggtcataaaagcctttactctcagtatcctgatctgtatacttctcaggaacgatatttttctcctcaaggtagaacacaacttcatttacgctttccttcacatcaacaagatcaaagtaatctaaagtgccttcaggaagaagaaggcgataaccgtttaactccataagctatgaatttggagacaaagataacaatttataaatttacccctcagctttttacattgacccaatttcagcccgtattctttgagactgagtccataaggattcctccttgtaaagcagataaatacttctcgctaacaactgcttccttgtatctccattagcgaaaacaggtgcatgatacatctttccacaggcctttgcataagcaatctgagtggactcttcatccaaagcctcccagcgagcttttacccgcatctcctgcacagctttataagctaccttctgtacgtgaaagcgatcggtaacacgtttggccgcaggaaagcagatgcgtgcaatctgctccatgttaggagccatatccaaagtaatctcgcgcacttggtaacggcggcgacgggatagcttaagcaggacagaagtgaccgtatgaacgtccgtacctttaatgatagcaatcatactacctttaccaccgtgagcttctttattggtcaggacagtatagagttccccacgcgagagggctacctcatcaatacagatacaagcaccgatattcttttcgaatagtagccaactctctgcatgaacaagttggtcccaatggagataaccacttagatggttacggtattgacgctccaataaatccccgtcaactccagataaaacacctaagagcttgcaactgatcggatagctatcaatatagttcttttaaaaaagacgcaaaatcctgcgtcatacgagtaccttcagccaccatacgccagttacgagagatatactcattatgcttctttaagatccagcgacgacgacgaatattaaggaagaccttcttgccacggagaggaaaatcctgaacaataacaggatcataaaagcctttactctcagtatcctgatctgtatacttctcaggaacgatatttttctcctcaagatagatcacaacttcatttacgctttccttcacatcaacaagatcaaagtaatctaaagtgccttcaggaagaagaaggcgataaccgtttaactccataagctatgaatttggaaacaaagataacaatttataaatttacccctcagctttttacattgaccccaatactttgtgtatgaattagttggctgattttgtaatatttaatgaatgtccctaatttatgatatcgtaataagaaaacaaatccccggtgcatcactgcagcggggattttccaccttaaattcatcttatgtcatttcaatgaattatatttcaatttctttatttgggttatttgcctaaattttaatgccaactttgtggcatgactttcacataattcgtcgtttcatcccatatataatctcctgtataattgcagttgaacagataatccgcatcacaacgaagtaatatccactcattggaattttcagctctccaatataaatgtaagactggaatggcatattttactccatcatgtcggggagcaagtcttttaactgggaatttacaactcataatacccttccagaaacgtgttcctgtcggaatgtccacagaatccttaccgatttcatctttccattcctcatcgtttactgctcctttctttttggtacttggactatatgaattagacttcagtttgaactcacgttcccaaactgcttttatttcgcctctcagcgccttttctccccggttggataaagtatataccagattccacggatcatcatcaggaaccggatatgcaagaatagaggtatatccctgtccttccacttccatcatgcgcaatgccggcagattatccgacgcaggcgctttcacctcatacagccattcctcgtccgtactgccataggaatatcccactgccctgcaccacatagtttctcctttcttgcggaataacggcacaagctggtatgtaccgggagcagaagtcacatagcactggatacgttttccatcccatgccccattcgtcttgatgtctatcggctggaactgctccacaatctcattcgtacccggcctcataaatacaaaccgtaactctccctcgccgttatcgcaatagggattgtaaaaggttccgaacaccttgccttcattctgatagcagtcatagccgtattcggtataattgggccataccttgaaaggatagtcttccggattcgggttgagtataatctggtccgtcttgccataccggctccagtactccacatcgatgtccacctgctccatgttgaccggggagttgtagtttcccgtcattttcagtgtataggtgtatttcattcccgcctcccattcatggtccctgtggaactcatagggatattcttttccgtcaatggtaaaacagactgtcgctttctggtcataaccgtagacagggggaagaattgtctccaccaccaccggatctgcatcgttcagatgatagtttccgccagcttgcaggctccccctgcttgagaaatcgaatatcaggggggagttggtttcccgcctgatgtcaagcgtcatccttgtgatcacattgtcaaaccttatatttgaaacaatgccttctcccatatattcatttttcagaattttgatgcgcaccaggctcatggcatgtttcatctcaatatctgctgtcggaatgtccctggtgactgttgcccttccatacaggatgtcgtgctggtccgccagttcaaaagggatgagcctgtcccctgatgcctgtccgttgtacggcagataagcggccacctccgaatcaccctctaccggagcgtccccgccggcattccattttttaccgtcaaaggcataaggcacattatatacatatggagagccggtgtcagtagtactgataaacacccccatctcatgtcccggcaggaatgcctctatgattccttttgtctgcatcgcctgcaacgatgcggttattccgagccgtatcttttcttcctcatcctttcccggatcatcccccggggtgacaactggcggttcaggttccggcaggatctcatccttttcacatgcggataatgcacatgtgagtgaggccaacaatatataccttaaaattttcattgtattacttttttcaatttataagtagatactaattgaaaagtgcgccaatattccagttgaaaattgcgccaccataccctatcatcttcatatgccatcttattttttagagacatttactgaatatccctagttatataataaaagaaggtgtctgaaatggacagcctccaaaagttagacataaaacttttagagggcacttcacttttcggacaccttcttttattgaaaccgtttcaagacttttagtatatctttggggttttctatcttaatcttttctgtttcaatgaactctttgataagttgttgcttatcttttgaatacaatttcagaagtgaatggatatttcgaaagcttctcaacttgcctttaatctgagtgtaataaacattttccgttaccattttatagaccgaaaggtctaaattctgttcaccgttaacacgttggaagcgtgtattgacatcaattgcttgaacactgccatgagtaactgttcccatagctcctttcttcccgatatcttttggctttactttccagtctataaaaagagtggtatgctgatcagtcatcacttccataaaatgtccctcaaacggaataaagcggtgtatatcaatgactactgtatcaatatcttccaaattctctataaccatgtctgtcgattcattcaaaaaatgcatttccttgtttatacagtcatagttaaatttccctttggcaaactgtttgtttttcaataaaacttttcctggagtaaattccttgaagaaatagccggcaggttgttgggcatttatcaacgttatgcttcccaatgctagaattgcaataagaattccttttgtattcatagtgatggagattttaattattcatactagtcctttgagccaaattgccaaaaaacgatcgtatactatatatccttgctgctcttttaagacaaactccttattaattaaagactttaatgctacatttatgctgctggctccttttaaatcatatttctttatgaatgtggcactgttaatctcatttacaatttcctctttggctatagctttcagcaactgaatctgattggaagttaaaaactggaaataggtttgataagtatattcttcctcctgtatgatttcctggatgagtgtatgcaacagctctatggtcggagtctgctgtggcaatgaatacaatctgtttaaaagatattgcatataccacgtatgtccttttaccgattgataaatttcatggaagatattttcctgcaaagtttttttcctttcatcaaacagtttcttggcaaactcccggtaaggagtataaggaataggggccaggaaaagtttctgcgtagattggtaaaaaggtcttttgatggaaaagaagatagactccatcaaatgctttttgctgcccgaaaagataaaatgcacattcggggtgaactggatatacgatctcaacaggccttccactcctttctccggatattccattatttgctggaattcgtcaatggctatataacattctactcccgattggtttaggtaggtgaaaatctctttcaaggtttcttctgaacgttccggaataaagtcgagtgttacagatggcattcctgtaatttcatcggcgctgatgaccggacggcaacttttaaagaatgagaatagcgattttaaggtactctgtgataaggtatctaatttccccaacacacttcgtcccagtagagatacaaactcctgaagattctgggttgaaaatatatccagataaaaacaggcggcagatttattttctttttgaatatagtaaaatacattctttattagtcctgtctttcccatacggcgcggactgattaatgtaacgtgagttcgaaataagaataaatatatttcacttataattagaaacatagcgaagaggctgtctcaaaatagagttgagatggcctcttttgtttcatctccaattgaagtcatttggatttttctcaaaaaaggagtttataaacttacttttgaaggtttcatcctttcaaactttttttttcgttgccataagccccctaagaggctacttttgcaagattatgtgcaatggccagcaggccgaactcaatttcaaccttcttaagcccacgaagatggaacctcttgaagtgcttgttgttcttgaggtttccaaatacggcttccacatcctgcggtcgctggctgcgatatttcaggccttcatcagagagcagtttttcacgttccctttccttgattttcctcagacgatggtttacctgcacaattctttccgaccggcttctgtgacaccggcatcttagcgggcagcctttgcagttacgtgccctgtatcttgagatggtctgcacaaaaccgttgtctgttatccgccttgcatcggagagtctttccattctctgtcccatcggacagtacatgccgtcggtttcttcattataataaaagttggcagagagaaacgggtcgttccggaagttccttttctgttccttatgaaaattgttgtactttataaaggtttcaatgccatgtctgaaggcgtacagatagttctcctcgcttccgtatccggcatcacagacagatacgtcagggtatctgccgtaaagggaatggaaattatccatatgcaggggataggtggaggtatcaccggcacactgatggatggtatagttcagaatgaactgtctgttggtactgatctggggattatatccgggtttgagctgtccgttcctcatgtggtcctctttcatgcgcatgaaagtagcgtcattgtctgtctttgagtagctgttgcgtccgtcaagtatctttccctgtgattcatatttcctgagctgttcgggccatgacttccttacacgtcttaccttcgctttcattttcctgtctgcatccactccgttcagggcatcatctatctggcaaagtgccttttccactttctccggagtgatatcctgatatgtgatgggtgcggaatcacgcagttcctgcttggtgacggactcggcgtactgccatatctcttcaagctgttccgcgattctggatatacgcgtatgtatggacttaccccagacgaacgtataacggttggcatccgcctccatcttcgtcccgtcggtacaggccacatccagacttacaaaaccttccgccacaaggaactttacgatggtggcaaatattgtcttgagtacatccttcagccggctgctgcggaaacggttgatggtattatggtcaggagtcacattgccggtaagccacatgaagcggatgtcattgcgacagaattcttctatgcgacggctggaatagatattacgcagataagcatagaccagaatctgaagcatcatgcgagggtggtatgcagaacagccttggggagaatacctgcggtaaagtttttcaaggtttatctgttcaatgatacggtgaacaacccggaccggatcgttctggggaataaaatcgcctaaacacggaggtaaaagcagattatcgttggatgtataacttttaaacatattaaagctccgggaacaagcgctctcgttcccggagctccccctgcacttttcacaaaggacaagggttctgatctaacattagtgccggctatgttccatttccggccggcagacggaaataacaggctgcaaaaacaaagttttttaactgctaaattactaaggaccctcatcgagaaggatcgttaagaacagcccgttttactaataggcattcttctcgccacggaagacattcgccaccgtcctgtacatgatgtaaaggtccagaccgaagctccagtgctccaaataccagatatcaccacggatacggccctccatgtcttttagttccttcgtttccccacggaaacccgtaacctggctccatcccgttatacccggtttcacaaaatgccgcaccatatatttattgatcagccttgaatattcctgcgtatggagaagcatgtgaggacgaggccccacgatactcatatcccccaacagcacattgataaactggggcagctcatctatattcgtcttacgcattatattgccccagcgcgtcttgcggggatcatgctccgtggcctgtatcctgtcggcatctgcatttactttcatactgcggaacttgtaacaataaaactccctgccgttcagcccgttccgtttctggcggaagaacagcgggccgggcatggtcaatccggtcactatcgccaccacaatcagaataaccggaaaaaacgtacaaaggaacaccgatgagactactatgtcaaaggttcttttcagcaggcggttccccggccaacttaagggatcggggcgaaggcccaggtaagggacgttccccatgatgttgaacgacatacggtggtggagataattgcgcacattgggcacactgaagaaatgtaccagatggttctcgcagtaatcaatcagagaaacgatgacctctctgtcttttgagggcaggcagcagaacaggtaatgtacataatcatgtttctccagatattcctgtacctgcgccggctggcccaaatacggacattctaccgggaaagcaggattcgcctgaccgtcaaaatagcccacgaccgaataacctgtatcttcactgcccgacatctcatggtagatttccaggttgttgtccgtacttcctaccagtactacaaaacgcgtatgtttcttgctcatacggtaaagcctgatgagaagacgaagagtgaaacggaacgaaacaagacacagaaacaggaggaaaaggtactccagcatgaacagggaggctatatccgcatactttcctacagaaaggaccagaccgcccaggaggacaaacaggaacatattctcgaacacacgtttccatatctgaagggaatgcactttcctccggtgaagcactactcctgaatggatggcgcaaagggcgtaacataacatcagtgtaagcatgacttgcagaacggtggttccaccaacctgcaggctatcccactgcatctcattggacagcttgctgaaaagcaggaatagcagaccgcaaagaaaggtctcggtgacaatcacaaaggtctcgatcaagtggttgtaggatgctaatttgtctttcatgtgacacgccggcgtcggagttcgccttgacgccttccgagatacccttgacctgcgcgcctacgccggtctttaggtttgcacttacgctgtcgaaatatcctacgtccgccataatatattttattcccagaatttatcaaactggatataattaccgaaccaaaacttaaatgcttctcggtttataccatccgaaggtgtccaaaaatcaacaggatattcccagtctgaattgtgtgactttttaggagcaagccctaagtttacatactcatggaatggacttttgtgttgtgccgtctccaatattccgcaaaagcccaatgtttgtagaagacattgggtctgagttttatttgtatcaaataattgaatcttattaattcttttgacgatatccttttttaatgtttcttgagatgaggcatctacaaggctcatcataatttcattaaaaatatgagcatcagtacagcttggctctattgcattatttgccaatttattaaactcagtcagtagtacaatgcaaaattcaagactaaaagctggaattcctccagcattggaagctatctctaaataaaaattataatcttcattttcaaatccagcccatgaatctatattgcagattttacaaggatcatcacgaaatctattaacttcattagaactgacaaagtgatgtcttgggaatgtacgcgttattgcgaatgctggtaaaaaacttcgccataacatattaccagtagaaaggcttgacaaaaaaaatgaaactattttattttttttgttaatacatttatcatactggataaacagttcttcaatcattttgtcatgaaggcaagtatattgttgattcataaaatgtaatttttaaccgtaactattctttttagtagctctatattcctcaaatgttttcctttctccatttgcgatgcgatcagaaagagacatttttttaagttttttctctgcactacgcatgtacaatttgcccttctcactatttttatccctaattccgtttattttatttcctcggacattgtcacttcgatatcctaacaacgatactgaagaattatctataccaacttgttctattcctctcactatcaatctatctgtacctttttttgttatttgtacaatagtatcaccttcaccgaaccttggtccatcagttccctttgttcctgcatgccttcttgccacatcatttatgttagcattatctgatgctcttccagaataatacacctcacctttagaattaataagaacatagttccaatcaagtccatataaatctataatcaagttcgtgtcgctgacgtagccatacaggttgagtattccgccagccagtccaatcggatcttgcgagacatacatgcccatcttcggcgagtagtacctgaacctgttgtatgccagtcctgtctcacagtgggacattcattaaatattacaaaatcagccaactaattcatacacaaagtattgcgaattagttggcttttttgtatctttaggtattcccccgaaaataagatttgacggccaaaacgggggaaatatccaaactaataagatatggcaaagatagtgaatatttcagaaattcaccctactttgggttttacagaatttgatattctggaaaaataccgcaagagttttaatgagagtgagcttggcaagcttcattcggtctttccgtttgaatgtatggcaaaagccgccggcctgtcggaccggcgcctgggacgcaggaacagattcagtccttccgcaaagatcgcccttatggtcctgaaggcatacaccggattctccgacaggcaactggtggaacatctgaacgggaacatacactaccagattttctgtggaattatgattcccccgtcccttcccataaccaacttcaagatagtcagtgccatccgtaatgagatagcatcccgccttgacattgattctttccaggagctcctggcttcacactggaaaccttatcttgataaccttcacgtctgcatgaccgatgccacatgctatgaaagccacatgcgttttcctacggacatgaaactcctttgggaaagcctcgaatggctctacaggcatatatgccggcattgcagggagctgggcataaggcgtccgcgcaacaaatacaggaatgtggcggaatcctatctgtcctactgcaagaaaagaaagaggagagcttcaaggacaagaatgcttaagcgccgtatgatcaagcttcttgaaaagctcctcagtcaaagggatgggatccatagcgagtacggtgctttactccgatatacccaggattatcataagcgtctttccatcatcagaaaggtgcttgtacaagaaaaggaaatgtttgaagggaggaaagtcagtgaccgcatcgtcagcattgaccgtcattatgtacgtcccatcgtcagaggcaaggaaaccaagtccgtcgagttcggtgcaaaggtcaataatatacagatagacggcatatcgttcatcgaacacctctcgttcaaggcattcaatgagggtatacgcttgaaggactgtatccgtatgcagcagaagcttatgaatgtaagggtaagatgtgtggctgccgattccatatatgccaataatgccaacagaaagttctgtacaaaatatgggatatccacatcctttgtgcgcaagggaagggcggccaaagatgagcctttgaggaaggtgcttagaagcgaactctcaaaagaaagggcaacacggcttgaaggaagcttcggcactcaaaagcaacattactcgctctcaaggataaaggccagaaacaggaagacggaaatactgtggattttctttggaatacatacggcaaatgccatactgattgccgcgatccatagctccggatacagtgaaactccatcctttcagttgttgtggagcataagttacttcaaacaaagagttgaattgtttcttgatctcattcagaggattatcataagtaccccaatggcgggagtaggagagcagcatacgataacttagcgactgacagggggaaccgcagaatcctatgtgatgtgccagtacacgattgctgataaaagtaatctgtccgttcttgttgtaaataggtccgggaagtaaaggattacctattcccattccccaatgctgccatccttgatagaggtagtgattataataattatctttagcactgatttgctcttcaaattccccccaaaaggaatcatacagcataggtccggtttgatcttttgttcctaatccttcgtatacaaaagtatcaatgaagcggtttttgggaaaagttatttccagtccgatgtgtccgtctttccaacgtccgtattggaaaaacatttgggagtggtcgtcgaaataatgttcataatagatctttaccttccaccggttaagataagctgttgcggcaaaattccagctaccgacatggtttccgtagatgtttacttgttcgccttcgggtgtggtatcatctccggccataggaaccaatacacgcataaagtcaacaaaccgggtaggcatatctattacaggctctttttgtcctgcaatatattggtctccgccaaattgggcggacatttgtattcctccttcaaattctaccggaaaatgttctttgtttcctactttggcgaaaagcgatttactgtggtaaagtacatcaatggtatatgggttgcctatggaggtgaaatgttcctgccatttgtcatcagtaaaacgtccataggctatgtgtcctttcaagtgaagccatttatgggtacctggtatggctacataatcgggaacttccaggcgtatttggggaatggggcgggcattatttgattctaccatacctccgctgcttaacttggaattctttaattcgggcaagcgttctttgctgccgatactcaggttcaaccatcggtaactgaggtctgcataggcttgttggatgatgaaggaggaggtgaaattgtaggcggttgccaaatccagtcctgcactgaagccgaaatgttggtttaatggcattgtatgtgcaatccctgcccgtaaataaccattttcggtattggcagaagataaaccttgcctgttggcagtaagccacatcggcgcgtaggttcctttacccgatgttcctcccatctcaacggtatattctgttttgacagggagttgggcattggtgtgctgcgtaatagatattaacagaaattgtaataagaatagttgtattttcttcatttagtttatgtgttttctgtttgcttttaaattcagcacaaagatagctatatttcaataaaatacaaacattttgtacacaaacgtgtacacgccataaaaacccgtttccaatcctaccgcccgttggttggttttgctttgctctttttccctatcgtttttctttttccgacagtaaatcaaccacttagctctataaattccccttgtctgttataagcatcgtctgtaatatgctctatcacttcttcgcaaacgcccataaataaagggattagaacatgtgtttccccacactttgggagtttagtccccacactttgggagtttaaaagtaaattagtccccacactttgggagttttacccctctttttttgttttaatgtggggattgtgtatatttgcagcaaatcaatcgtttatgaaaaagaaactacctattaccaagaataaagatgttgttgtttcatgggtatatacatggtcaaaacagcaagacatgtccatacacgaacaaagaatagttcttcgcatactggaagcgtgccaagctgaactaaagggagtaaaactgaaagattatgcaggcacgaaacgcaagtttgagcatggactttgggatgttgatgcacaaatgcatgtatctgacgttattttttccggacgtgattacaatgaaatcatagccgcactcgattctttggcaggacgtttttttacttacgaagatgacgaggaatggtggaagtgcggatttatatctaacccaaaatataaaaaacgcactggcattataacctttcgtgtgtctaacgacctttgggatgtgtttaccaagttcgccaaggggtacagagaatttgagttaaacaaggctcttgcgctacctactgggtattcccttaggttttacatgttaatgagtgggcaggtgtaccctttggatatatcccttgaaaacttgaaagaccgtcttggcatacctgcggacaaatacaaggacaagaacggaaaagacagaatagatcattttgaggaaagagttttgaaaccagcaaaggctgcgcttgatgagagctgcccatacactttcaactacgtgaaagtgcgtgaaaacccaaacaacaaacgtagcaaggtgaccgggtttaggttctacccggtctatcaaccacagttcagagatgaagaactggaagggaaagaattgcaagcaaaggttacagcacgatatcagatagacagccatgtgtacgagtacctccgttattcctgcggcttcacatcggaagagataaaccggaacaaagagacattcataacggcacaagaaatctgtttgcttttaaattcagcacaaagatagctatatttcaataaaatacaaactttttgtacacaaatgtgtacacgccataaaaagcagctcacagtcctaccgcccgttggttggttttgctctttttccctattgtttttctttttccgacagtaaatcagccatttaactctataaatttcccttgtctgttataagcatcgtctgtaatatgctctatcacttcttcgcaaatacccatgaataaagggattaaagcatgagtttccctacattttgggagttttaatcctacactttgggagtttttcacctcactattccctacactttgggagttttacccttctttttttgtttcaatgtaggttttatgtatatttgcagcaaatcaatcgcttatgaaaaagaaactacctattaccaaaaacaaagatgttgttgtttcatgggtatatacatggtctaaacagcaagatatgtccatacacgaacaaagaatagtacttcgtatcttggaagcatgccaggcagaattgaaaggggtaaagctgaaagattatgcaggtacgaaacgcaaatttgagcatggactttgggatgttgatgcacaaatgcatgtctcggacgttattttttccggacgtgattacaatgaaatcatagccgcactcgattctttggcaggacgttttttcacttacgaagatgacgaggagtggtggaagtgcggatttatatctaatcccaaatataaaaaacacactggcattataacctttcgtgtgtctaatgacctttgggatgtgtttaccaagttcgccaaggggtacagagagtttgaattaaacaaggctcttgcgctgcctaccgggtattcccttaggttttacatgctaatgagtgggcaagtgtaccctttggatatatcccttgacaacttgaaagaccgccttggcataccagcggacaagtacaaggacaagaacggaaaagatagaattgacaacttcgaggaaagggttttaaaacctgcaaaggctgcgcttgatgagagttgcccatacactttcaactacgtgaaagtgcgtgaaaacccaaacaacaaacgtagcaaggtgaccggatttaggttttacccggtctatcagccacagttcagggatgaagaactggaagggaaagaattgcaggcaaaggttacagcacgatatcagatagacagccatgtatacgagtatctccgttattcctgcggtttcacatcggaagagataaaccggaacaaagagacattcataacggcacaagaaagtgacacgccggcgtcggagttcgccttgacgccttccgagatacccttgacctgcgcgcctacgccggtctttaggttagcactcacgctgtcgaaataacctgtgtccgccataactatgtgcttgcattaagctgttaccattcggaacatctaaatttatcaaaagtctttaaattcatcgttttccataaaaaagattaaggcttctatataatctttttctgatggtatgccaatttgatccattacatttaataatatatcttcaaattgttcgccataatacaataattccaaattttctttctgtacaaaatcgggataaacttcttcatcatttttaatttcaggatatttatcaatgaagcatagttgatcccactgtatattttcacttttagaatatatacaataattctcatttgagaatccatgtacctgtatctgctgggatacttgtttgattataaaacctaaagtataaggcttttctgattttaaattatccatatatttattattttttttgtttataacctgtggaaccatttaatcgtcctttacgaccatcattaccaccaccccataaatctcgcccacctttacctgatggatgataaagtttatgattgagtgaatgatctcttctgtccaccaagaccagtctccttgtttcttcatgatgatgccatgtaaaaccagacgggcttgatgtcatgtttggatttttaatccatgcatgtagttctggatgcctttttaacatatcatgcttaaagattgcatcagaattgattttatttagaaattcttgatttgctctattaaattggacagcatcacttgcgtattggtctttcgcattcactgtatgctcaaaaaagatgtgatactttccattattggggcgtgtagctaaaccaagaacatcactccacgcatttgtatcatcgacatacccatataaattgagtattccaccaccaagtccaatcgggtcttgcgagacgtacatccccatcttcgggtcatagtacctgaacctgttatatgccagccctgtctcccgatcataatactgtccctggaacaggaacggtaccattcccttgttgcccgtttcctcgatgacgttcccgtccatgtcgagtacccggctccacacctcgttgccctcggcatcgtatgcctccgtcggtgttccgagctggtcggtcagtatcgagtaggacctgccctccctgagcattgccagtttgtattttattgaaatatagctatctttgtgctgaatttaaaagcaaacagatatggaagcattatcagtaagagaataccgtaacaacctcgcagcgtctttcaccaaagctgacaatggcgagcaggtactaattcgcaggaaaaacgagatttacgctttggtaaaagttggtcgtgaagatttgatgataaccccggagctgcaagcaaggattgacaaggcaagggaagaaatcaaatccggaaagtgtgttaccctcaaaagcagtgaggatattgacgcttatttcgatagtctatgatgtacacaattagggtttccgacggggtggataaggtgattgccaaatggaagaaatcaaaccccaatttgttcaagaagtataagaaaatctacaaagaattgttagagcaccctaagactgggcttgggcatcccgaagcgttaaggggcggtggggatattacatggtctcgacacattaccgcccatgaccggataatctatgacatttacgaggaagtggtagaggtctacatcttggaggtagaggggcattacaacgataaatgataaaactgttatggtcgaatattgtgtttactggttagagaacggcgagcctatgcacgaggtgttctcttctcttgccgccgccgagatgtactcatgtgcgataagagggaaagaaaacattgaatgggtggaggtgtccgaagaagaaaccattgatttggacgaactggaagacatgttcccggatgacttctgcggcgtgtaatccccttgggtagaaatggggtagaatttgttaggctgtgggggattttctaacacgccggggctttttgccgggcggttggcgtggatgtattcccatgcggcatgtgtatatatagcaagaagtgtccttgtcggacaattcttgcttttctcgctttgctcaaaaagattttaagattacctttgtggcatggaactaagacggaacgaaaagattacattccggtgtaccgaacttgaaaaggacgcacttgcggagcaggcagcccggtgcagtctaagcgtatcggaatactgccggagtttgtcccttggggggcgcccaagggagaggtacaccgaggaggaacggcagcttctccgggacatagcccagttgaaaggaacgctccaacggctgaacaactacttcggtggtcgccagtaccgggacgtttgtccacataaccgccgtttttcattctgtacccctgccgttcaaagtccgccaacacgttttttaggcgattttcggcactttcaaggcttttcccgtctatttgtacctttcgggctgttgcgtcctctatgcgcttcgtatagacttcaacacgctttagttcttgatacaccagttctaccgcaagctgcgggtttacccttggcgttgtatcttttcttttccgggggctgtactgtccctgcttaacgttggaagctgccgcttccgggtgtgagtttgtttccatgagatatgttcattgagttgcacttcagtttgctttgtgtccgctcgatatgggcgagagtgtagcctttccctatctcgcttgccttatactccgtaccgcttcgggctgtgacatagtagccgttaagtttcccggtgcttgccctggcttcccggactttaaaacctctcttaccaagttcttccttgaatttggtaaagtcaaagccctgcatcttcttcaatacgccgtccatggcttccttgatttccgctttgttgactttgccaatgtcctgcgactgtacaaagttccgttccttggctatggcattggcggcttccgttgcctttttccctatccagttgtcccggtacagttccccggaaagggaaacccggtttgccagtatgtgcaggtgggcttgctctttcttgctctccgtaccgctgtgccggatgatgatgtactggtggttcgccaaccccatgcgctgcatgaagtcgttaccaagttccgcccagtccgcatccgtaaaggtggcgctttcctctatcgaggggctgacctcgaaacgtaggcagttgttttttacgttcggaaaatcaatgtgatacggtttcatttcctgcaccatttccgcaccagtacacccataaagttcatgccgggctatctcggtggctactgcctgcccgtttatctctttggcgaggtcgtactccaatgccgccacaccatgtgatatgcttttccctttccctatcatcgtgagagtatttttttgagctctgtaattagtgcccggttctcctcgaacacttcccggtactggcgaccaccgaagtagttgttcagccgttggagcgttcctttca
